(12) United States Patent
Bermudez et al.

(10) Patent No.: US 12,129,495 B2
(45) Date of Patent: Oct. 29, 2024

(54) ENGINEERED DNA POLYMERASE VARIANTS

(71) Applicant: Codexis, Inc., Redwood City, CA (US)

(72) Inventors: Ericka Bermudez, Aptos, CA (US); David Elgart, San Mateo, CA (US); Nikki D. Kruse, San Carlos, CA (US); Mathew G. Miller, San Carlos, CA (US); Vesna Mitchell, Santa Clara, CA (US); Jovana Nazor, Milpitas, CA (US); Nandhitha Subramanian, Cambridge (GB)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 18/046,895

(22) Filed: Oct. 14, 2022

(65) Prior Publication Data
US 2023/0193224 A1 Jun. 22, 2023

Related U.S. Application Data

(60) Provisional application No. 63/256,492, filed on Oct. 15, 2021.

(51) Int. Cl.
*C12N 9/10* (2006.01)
*C12N 9/12* (2006.01)
*C12N 15/63* (2006.01)

(52) U.S. Cl.
CPC ............ *C12N 9/1252* (2013.01); *C12N 15/63* (2013.01); *C12Y 207/07007* (2013.01)

(58) Field of Classification Search
CPC .................................................. C12N 9/1252
See application file for complete search history.

(56) References Cited

U.S. PATENT DOCUMENTS

| | | |
|---|---|---|
| 4,683,195 A | 7/1987 | Mullis et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer |
| 6,287,862 B1 | 9/2001 | Delcardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | Delcardayre et al. |
| 6,335,160 B1 | 1/2002 | Patten et al. |
| 6,335,198 B1 | 1/2002 | Delcardayre et al. |
| 6,337,186 B1 | 1/2002 | Krebber |
| 6,344,356 B1 | 2/2002 | Stemmer |
| 6,352,859 B1 | 3/2002 | Delcardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | Delcardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |

(Continued)

FOREIGN PATENT DOCUMENTS

| | | |
|---|---|---|
| EP | 3049973 A | 8/2016 |
| WO | 1995/22625 A1 | 8/1995 |

(Continued)

OTHER PUBLICATIONS

Lucas. E4U7R3_OCEP5. UniProtKB/TrEMBL Database. Oct. 7, 2020.*
Zhou. HGY10327.1. GenBank Database. Mar. 16, 2020.*
Fransceus . J Ind Microbiol Biotechnol. May 2017;44(4-5):687-695.*
Sanavia. Computational and Structural Biotechnology Journal, vol. 18, 2020, pp. 1968-1979.*
Studer. Residue mutations and their impact on protein structure and function: detecting beneficial and pathogenic changes. Biochem. J. (2013) 449, 581-594.*

(Continued)

*Primary Examiner* — Yong D Pak

(74) *Attorney, Agent, or Firm* — Codexis, Inc.

(57) ABSTRACT

The present disclosure relates to engineered DNA polymerase polypeptides and compositions thereof, as well as polynucleotides encoding the engineered DNA polymerase polypeptides. The present disclosure also provides methods of using the engineered DNA polymerase polypeptides or compositions thereof for diagnostic and other purposes.

35 Claims, No Drawings

Specification includes a Sequence Listing.

(56) References Cited

U.S. PATENT DOCUMENTS

| | | |
|---|---|---|
| 6,436,675 B1 | 8/2002 | Welch et al. |
| 6,444,468 B1 | 9/2002 | Stemmer |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | Delcardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | Delcardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | Delcardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | Delcardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | Delcardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | Delcardayre et al. |
| 8,383,346 B2 | 2/2013 | Colbeck et al. |
| 8,457,903 B1 | 6/2013 | Emig et al. |
| 8,504,498 B2 | 8/2013 | Fox et al. |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 9,665,694 B2 | 5/2017 | Cope |
| 9,684,771 B2 | 6/2017 | Cope et al. |
| 9,896,671 B2 * | 2/2018 | Ignatov ............... C12N 9/1252 |
| 2004/0000557 A1 | 1/2004 | Shepler |
| 2006/0195947 A1 | 8/2006 | Davis et al. |

FOREIGN PATENT DOCUMENTS

| | | |
|---|---|---|
| WO | 1995/33836 A1 | 12/1995 |
| WO | 1996/00787 A1 | 1/1996 |
| WO | 1997/00078 A1 | 1/1997 |
| WO | 1997/35966 A1 | 10/1997 |
| WO | 1998/27230 A1 | 6/1998 |
| WO | 2000/42561 A2 | 7/2000 |
| WO | 2001/75767 A2 | 10/2001 |
| WO | 2009/152336 A1 | 12/2009 |
| WO | 2010/144103 A1 | 12/2010 |
| WO | 2015/048573 A1 | 4/2015 |
| WO | 2015/073931 A1 | 5/2015 |
| WO | 2021/178709 A1 | 9/2021 |

OTHER PUBLICATIONS

Smith et al., "Comparison of biosequences," Adv. Appl. Math., 2:482-489 [1981].

Needleman et al., "A general method applicable to the search for similarities in the amino acid sequence of two proteins," J. Mol. Biol., 48:443-453 [1970].

Pearson et al., "Improved tools for biological sequence comparison," Proc. Natl. Acad. Sci. USA 85:2444-2448 [1988].

Altschul et al. "Basic local alignment search tool," J. Mol. Biol., 215: 403-410 [1990].

Altschul et al.,"Gapped BLAST and PSI-BLAST: a new generation of protein database search programs," Nucleic Acids Res.,25, 17, 3389-3402 [1977].

Henikoff et al., "Amino acid substitution matrices from protein blocks," Proc. Natl. Acad. Sci. USA 89, 22:10915 [1989].

Tindall et al., "Fidelity of DNA synthesis by the Thermus aquaticus DNA polymerase," Biochem., 1988, 27, 16:6008-6013.

Barnes, "The fidelity of Taq polymerase catalyzing PCR is improved by an N-terminal deletion," Gene, 1992, 112:29-35.

Villa-Kamaroff et al., "A bacterial clone synthesizing proinsulin," Proc. Natl Acad. Sci. USA, 1978, 75,8:3727-3731.

DeBoer et al., "The tac promoter: a functional hybrid derived from the trp and lac promoters," Proc. Natl Acad. Sci. USA, 1983, 80,1: 21-25.

Romanos et al., "Foreign Gene Expression in Yeast: a Review," Yeast 8:423-488 [1992].

Guo et al., "3'-End-Forming Signals of Yeast mRNA," Mol. Cell. Biol., 15, 11:5983-5990 [1995].

Simonen et al. , "ProteinSecretioninBacillusSpecies," Microbiol. Rev., 1993, 57,1:109-137.

Stemmer, "DNA shuffling by random fragmentation and reassembly: in vitro recombination for molecular evolution," Proc. Nat. Acad. Sci. USA, 91,22:10747-10751 [1994].

Zhao et al., "Molecular evolution by staggered extension process (StEP) in vitro recombination," Nat. Biotechnol., 16:258-261 [1998].

Caldwell et al., "Mutagenic PCR," PCR Methods Appl., 3,6 :S136-S140 [1994].

Black et al., "Creation of drug-specific herpes simplex virus type 1 thymidine kinase mutants for gene therapy," Proc. Natl. Acad. Sci. USA 93:3525-3529 [1996].

Ling et al., "Approaches to DNA Mutagenesis: An Overview," Anal. Biochem., 254(2):157-178 [1997].

Dale et al., "Oligonucleotide-Directed Random Mutagenesis Using the Phosphorothioate Method," Meth. Mol. Biol.,57:369-374 [1996].

Smith, "In Vitro Mutagenesis," Ann. Rev. Genet., 19,1:423-462 [1985].

Botstein et al., "Strategies and applications of in vitro mutagenesis," Science, 229, 4719:1193-1201 [1985].

(56) References Cited

OTHER PUBLICATIONS

Carter, "Site-directed mutagenesis.," Biochem. J., 237,1:1-7 [1986].
Kramer et al., "Different base/base mismatches are corrected with different efficiencies by the methyl-directed DNA mismatch-repair system of *E. coli*," Cell, 38,3:879-887 [1984].
Wells et al., "Cassette mutagenesis: an efficient method for generation of multiple mutations at defined sites," Gene, 34,2-3:315-323 [1985].
Minshull et al., "Protein evolution by molecular breeding," Curr. Op. Chem. Biol., 3,3:284-290 [1999].
Christians et al., "Directed evolution of thymidine kinase for AZT phosphorylation using DNA family shuffling," Nat. Biotechnol., 17,3:259-264 [1999].
Crameri et al., "DNA shuffling of a family of genes from diverse species accelerates directed evolution," Nature, 391:288-291 [1998].
Crameri, et al., "Molecular evolution of an arsenate detoxification pathway by DNA shuffling," Nat. Biotechnol., 15:436-438 [1997].
Zhang et al., "Directed evolution of a fucosidase from a galactosidase by DNA shuffling and screening," Proc. Nat. Acad. Sci. U.S.A., 94,9:4504-4509 [1997].
Crameri et al., "Improved Green Fluorescent Protein by Molecular Evolution Using DNA Shuffling," Nat. Biotechnol., 14:315-319 [1996].
Stemmer, "Rapid evolution of a protein in vitro by DNA shuffling," Nature, 370:389-391 [1994].
Beaucage, S.L., et al. "Deoxynucleoside Phosphoramioites—A New Class of Key Intermediates For Deoxypolynucleotide Synthesis." Tetrahedron Letters 22: 1859-69, 1981.
Matthes, H.W.D., et al., "Simultaneous rapid chemical synthesis of over one hundred oligonucleotides on a microscale," EMBO J., 3(4):801-05 (1984).
Peters et al., "Bacterial Transcription Terminators: The RNA 3'-End Chronicles," J Mol Biol., 412(5):793-813(2011).
UniProtKB Accession No. E4U7R3_OCEP5 "DNA polymerase I" Sep. 29, 2021 [online]. [Retrieved on Dec. 12, 2022]. Retrieved from the internet: <URL: https://rest.uniprot.org/unisave/E4U7R3?format=txt&versions=64>; entire document.
UniProtKB Accession No. A0A511RJX5_9DEIN "DNA polymerase I" Sep. 29, 2021 [online]. [Retrieved on Feb. 3, 2023]. Retrieved from the internet: <URL: https://rest.uniprot.org/unisave/A0A511RJX5?format=txt&versions=9>; entire document.
International Search Report and Written Opinion for international Application No. PCT/US2022/078169, Mar. 6, 2023, 11 pages.

* cited by examiner

ENGINEERED DNA POLYMERASE VARIANTS

CROSS-REFERENCE TO RELATED APPLICATIONS

This application claims the benefit under 35 U.S.C. § 119(e) of U.S. Provisional Application No. 63/256,492, filed Oct. 15, 2021, which is incorporated by reference herein in its entirety.

REFERENCE TO SEQUENCE LISTING, TABLE OR COMPUTER PROGRAM

The Sequence Listing concurrently submitted herewith via EFS-Web as file name CX9-218US1_ST26.xml, created on Oct. 14, 2022 with a file size of 2.21 Mbytes, is incorporated by reference herein.

TECHNICAL FIELD

The present disclosure provides engineered DNA polymerase polypeptides and compositions thereof, as well as polynucleotides encoding the engineered DNA polymerase polypeptides. The disclosure also provides methods for use of the recombinant DNA polymerase or compositions thereof for diagnostic, molecular biological tools, and other purposes.

BACKGROUND

DNA polymerases are enzymes that synthesize DNA from deoxyribonucleotides. These enzymes are essential for DNA replication. There are various types of DNA polymerases displaying different properties and found in different types of organisms. Polymerases obtained from thermophilic organisms have found wide ranging vital uses in various in vitro methods, including but not limited to the polymerase chain reaction (PCR), nucleic sequencing, and other diagnostic, molecular biological, and forensic applications. While there are numerous commercially available thermostable DNA polymerases, such as Taq and Pfu DNA polymerases, a need remains in the art for thermostable enzymes with improved properties, such as enhanced processivity and/or fidelity.

SUMMARY

The present disclosure relates to engineered DNA polymerase polypeptides and compositions thereof, as well as polynucleotides encoding the engineered DNA polymerase polypeptides. The present disclosure also provides methods of using the engineered DNA polymerase polypeptides and compositions thereof for diagnostic and other purposes.

In one aspect, the present disclosure provides an engineered DNA polymerase, or a functional fragment thereof, comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 2, 8, 332, 462, or 606, or to a reference sequence corresponding to SEQ ID NO: 2, 8, 332, 462, or 606, wherein the polypeptide sequence comprises one or more substitutions relative to the reference sequence corresponding to residues 12 to 850 of SEQ ID NO: 2, 8, 332, 462, or 606, or to the reference sequence corresponding to SEQ ID NO: 2, 8, 332, 462, or 606.

In some embodiments, the engineered DNA polymerases, or a functional fragment thereof, comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 850 of SEQ ID NO: 2 or to the reference sequence corresponding to SEQ ID NO: 2, wherein the polypeptide sequence comprises one or more substitutions relative to the reference sequence corresponding to residues 12 to 850 of SEQ ID NO: 2, or to the reference sequence corresponding to SEQ ID NO: 2.

In some embodiments, the engineered DNA polymerases, or a functional fragment thereof, comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 850 of SEQ ID NO: 8, 332, 462, or 606, or to the reference sequence corresponding to SEQ ID NO: 8, 332, 462, or 606, wherein the polypeptide sequence comprises one or more substitutions relative to the reference sequence corresponding to residues 12 to 850 of SEQ ID NO: 2, or to the reference sequence corresponding to SEQ ID NO: 2.

In some embodiments, the polypeptide sequence of the engineered DNA polymerase comprises at least a substitution at amino acid position 15, 16, 20, 21, 22, 40, 41, 52, 57, 58, 73, 85, 87, 88, 91, 102, 109, 132, 157, 177, 186, 200, 213, 217, 231, 232, 242, 243, 262, 263, 264, 265, 273, 299, 321, 322, 328, 384, 386, 401, 402, 403, 404, 406, 407, 440, 476, 480, 491, 495, 498, 503, 504, 506, 507, 508, 511, 514, 520, 521, 523, 524, 525, 526, 527, 528, 529, 530, 533, 534, 535, 536, 537, 538, 539, 540, 542, 553, 554, 555, 556, 557, 558, 559, 560, 562, 563, 566, 570, 572, 581, 582, 584, 585, 586, 587, 589, 592, 593, 594, 595, 596, 597, 599, 601, 602, 603, 605, 607, 616, 665, 671, 674, 675, 677, 684, 688, 696, 704, 705, 706, 728, 735, 747, 748, 749, 750, 751, 753, 755, 756, 762, 763, 764, 766, 772, 773, 779, 793, 803, 814, 820, or 849, or combinations thereof, wherein the amino acid positions are relative to the reference sequence of SEQ ID NO: 2.

In some embodiments, the polypeptide sequence of the engineered DNA polymerase comprises at least a substitution 15A/G/K/N, 16R, 20A/C, 21K/Q/S, 22K, 40A, 41F, 52R, 57T, 58N, 73A, 85E/P/R/S, 87N, 88T, 91K, 102V/M/S, 109P, 132Y, 157G, 177T, 186E, 200V, 213P, 217E, 231E, 232C, 242Q, 243L/S, 262L, 263A, 264T, 265I, 273M, 299N, 321G, 322N/S, 328I, 384Y, 386V, 401A/G/I, 402G/R, 403L/R, 404S/T, 406K/Q, 407R/W, 440G, 476I/N, 480E/V/W, 491G, 495E/M/S, 498D, 503I/V, 504M, 506P, 507K, 508H, 511M, 514F, 520P, 521G/W/Y, 523A/K/V, 524G/K/Q, 525L/V, 526T, 527V/W, 528A/Q/R/W, 529S, 530G/P/R/W, 533L/P/Q/V, 534H/W, 535K, 536R, 537G/L/W, 538A, 539L/R, 540H/V, 542G/M/T/W, 553F/K/N/R, 554E, 555H/K/M/W, 556F/M/P/W, 557G/H, 558R/S/V/Q, 559D/G/P, 560G/M, 562S, 563L, 566A, 570R, 572I, 581A, 582F, 584N, 585KR, 586M, 587Q, 587S, 589G/L/R/S/W, 592G/T/V, 593N, 594C/Q/T/V/W, 595A/P/R, 596L/R/W, 597E, 599G/S/T, 601M/P, 602V, 603G/V/W, 605E/A, 607N, 616A, 665V, 671E/R, 674T, 675L, 677M, 684V, 688I, 696H/V, 704P, 705W, 706E, 728K, 735G/L, 747T, 748Y, 749L/R/T, 750S/P, 751H, 753K/V, 755P, 756N/T, 762M/Q/V, 763G/Y, 764A/I/V, 766Y, 772I, 773R, 779I, 793G, 803C/R, 814E, 820A, or 849T, or combinations thereof, wherein the amino acid positions are relative to the reference sequence of SEQ ID NO:2.

In some embodiments, the polypeptide sequence of the engineered DNA polymerase polypeptide comprises at least a substitution at amino acid position 40, 85, 102, 132, 157, 177, 262, 263, 748, 521, or 750, or combinations thereof, wherein the amino acid positions are relative to the reference sequence of SEQ ID NO: 2. In some embodiments, the polypeptide sequence of the engineered DNA polymerase polypeptide comprises at least a substitution 40A, 85E, 102S, 132Y, 157G, 177T, 262L, 263A, 748Y, 521G, or 750S, or combinations thereof. In some embodiments, the polypeptide sequence of the engineered DNA polymerase polypeptide comprises at least a substitution S40A, P85E, V102S, V132Y, S157G, R177T, I262L, S263A, H748Y, A521G, or P750S, or combinations thereof.

In some embodiments, the polypeptide sequence of the engineered DNA polymerase polypeptide comprises at least a substitution or substitution set at amino acid position 213/503/508/584/748, 40/132/748, 40/132/157/262/263/748, 132, 40/132/503/748, 40/132/157/503/562, 40/132/213/748/814, 132/157/562/584, 132/584/748, 40/132/231/684/748, 40/132, 40/41/132/562/684/748, 41/213/231/503/650/674/748, 132/231/503/748, 40/132/157/503, 503/748/814, 40/132/231/503/674/748, 40/88/132/503/684/748, 132/157/213/674/748/814, 157/263/748, 40/748, 41/157/231/262/748/814, 40/213/503/562/584/748, 523/524, 40/132/503/514/650/674, 40/132/157/213/231, 41/213/520/814, 40/41/157/231/503, 40/157/503, 40/132/562/748, 132/748, 40/41/132/562/748, 88/213/503/584/684/748, 57/58/523/616/677, 40/213/231/503/514/562/748, 132/562, 213/503/650, 40/41/88/231/748/814, 41/213/262/562, 41/88/231/748, 213/263/748, 40/157/213, 157/520, 40/132/263/503/674/814, 40/41, 524/665/756, 58/186/217/523/524/677, 40/41/748, 132/514, 520, 41/213/503/562, 231/503/748/772, 503/562, 73/232/514/584/814, 58/507/616, 132/262/520/562/684/748, 88/562/814, 41/88/157/814, 88/157/213/674/684, 57/58/523/779, 40/132/157/514/520/684, 40/41/213/684/772, 40/41/231/503/814, 88/213/503/584/814, 40/41/132/562/584, 41/88/213/231/503/650/748, 40/503, 40/132/213/231/520/562/650/814, 40/41/132/231/262/503/562/584/748/814, 57/58/264/265/524/688, 88/132/157/262/263/520/562, 88/132/157/262/503/514/562/650, 40/584/674/748, 40/41/132/263/503, 584/748, 40/213/674, 40/41/88T/132/503/562/584/748, 88/213/514/562/748/814, 263/520/814, or 40/41/88/157, wherein the amino acid positions are relative to the reference sequence of SEQ ID NO: 2.

In some embodiments, the polypeptide sequence of the engineered DNA polymerase polypeptide comprises at least a substitution or substitution set at amino acid position 22/407, 328, 401, 402, 403, 404, 406, 407, 503, 504, 506, 521, 523, 524, 525, 526, 527, 528, 529, 530, 531, 533, 534, 535, 536, 537, 538, 539, 540, 542, 553, 554, 555, 556, 557, 558, 559, 560, 563, 581, 582, 585, 586, 587, 589, 592, 592, 592, 593, 594, 595, 596, 597, 598, 599, 601, 602, 603, 605, 607, 696, 747, 749, 751, 762, 763, 764, 766, 773, or 803, wherein the amino acid positions are relative to the reference sequence of SEQ ID NO: 2.

In some embodiments, the polypeptide sequence of the engineered DNA polymerase polypeptide comprises at least a substitution or substitution set at amino acid position 750/820, 21/52, 20/21/85/322/476/495, 20/85/200/322/476/495/750, 476/750, 20/476, 20/322/386, 85/322/476, 52/322/498/750, 20/322/476/820, 85/476/495/820, 21/85/322/820, 20/299/322/386/476/495/820, 20/322, 21/820/849, 476, 322/820, 21/322/386/820, 322/386/495, 85/386/495/750, 20/85/476/750, 20/386/476, 85/322/386/476/495, 20/495/820, 750, 21/322/495, 52/386/495/820, 21/322, 85/322/750/820, 20/52/85, 21/52/572, 20/85/495/849, 85/750, 21/495/820, 273/322/849, 495, 322/750/820, 52/476/495/566/750/849, 386/495, 495/820, 21/322/495/750/820, 21/85/322/386/495/820/849, 476/495/750, 386/849, 476/495, 85/476/849, 21/322/750, 20/85/566/820, or 386/750/849, wherein the amino acid positions are relative to the reference sequence of SEQ ID NO: 2.

In some embodiments, the polypeptide sequence of the engineered DNA polymerase polypeptide comprises at least a substitution or substitution set at amino acid position 299/386/566/820, 476/820/849, 21/322/476/495/820, 177, 21/495, 476/820, 20/52/299, 52/299, 322/820, 20/820, 20/299/386/476, 386/476/820, 476/495/820, 386/476/495, 20/21/299/322/386, 322/386/495, 21/299/322/476/495/820, 21/299/386/820, 299/476/820, 20/21, 21/85/102/750, 705, 21/386/476/820, 820, 21/299/322, 20/21/322/386/820, 299, 21/299/386/476, 109, 322/495, 491, 52/820, 21/386/820, 20/21/495, 21/299/322/495/566/820, 20/21/299/495, 756, 386/820, 495, 511, 21/52/242/386/495/820, 299/476/495, 706, 21/299/386/476/495, 21/299/322/495, 21/476/849, 299/322/476/820, 21/52/299/322/820, 20/21/566, 20/52, 322/386/495/566/820, 21/299, 21/299/386, 386/849, 52/476, 52/299/322/386/495, 440, or combinations thereof, wherein the amino acid positions are relative to the reference sequence of SEQ ID NO: 2.

In some embodiments, the polypeptide sequence of the engineered DNA polymerase polypeptide comprises at least a substitution or substitution set at amino acid position 22/40/132/157/262/263/407/748, 40/132/157/262/263/328/748, 40/132/157/262/263/401/748, 40/132/157/262/263/402/748, 40/132/157/262/263/403/748, 40/132/157/262/263/404/748, 40/132/157/262/263/406/748, 40/132/157/262/263/407/748, 40/132/157/262/263/503/748, 40/132/157/262/263/504/748, 40/132/157/262/263/506/748, 40/132/157/262/263/521/748, 40/132/157/262/263/523/748, 40/132/157/262/263/524/748, 40/132/157/262/263/525/748, 40/132/157/262/263/526/748, 40/132/157/262/263/527/748, 40/132/157/262/263/528/748, 40/132/157/262/263/529/748, 40/132/157/262/263/530/748, 40/132/157/262/263/531/748, 40/132/157/262/263/533/748, 40/132/157/262/263/534/748, 40/132/157/262/263/535/748, 40/132/157/262/263/536/748, 40/132/157/262/263/537/748, 40/132/157/262/263/538/748, 40/132/157/262/263/539/748, 40/132/157/262/263/540/748, 40/132/157/262/263/542/748, 40/132/157/262/263/54/748, 40/132/157/262/263/553/748, 40/132/157/262/263/554/748, 40/132/157/262/263/555/748, 40/132/157/262/263/556/748, 40/132/157/262/263/557/748, 40/132/157/262/263/558/748, 40/132/157/262/263/559/748, 40/132/157/262/263/560/748, 40/132/157/262/263/563/748, 40/132/157/262/263/581/748, 40/132/157/262/263/582/748, 40/132/157/262/263/585/748, 40/132/157/262/263/586/748, 40/132/157/262/263/587/748, 40/132/157/262/263/589/748, 40/132/157/262/263/592/748, 40/132/157/262/263/593/748, 40/132/157/262/263/594/748, 40/132/157/262/263/595/748, 40/132/157/262/263/596/748, 40/132/157/262/263/597/748, 40/132/157/262/263/598/748, 40/132/157/262/263/599/748, 40/132/157/262/263/601/748, 40/132/157/262/263/602/748, 40/132/157/262/263/603/748, 40/132/157/262/263/605/748, 40/132/157/262/263/607/748, 40/132/157/262/263/696/748, 40/132/157/262/263/747/748, 40/132/157/262/263/748, 40/132/157/262/263/748/749, 40/132/157/262/263/748/751, 40/132/157/262/263/748/762, 40/132/157/262/263/748/763, 40/132/157/262/263/748/764, 40/132/157/262/263/748/766, 40/132/

157/262/263/748/773, 40/132/157/262/263/748/803, 40/132/157/605/262/263/748, 40/132/157/262/263/403/521/748, or 40/132/157/262/263/403/553/748, wherein the amino acid positions are relative to the reference sequence of SEQ ID NO: 2.

In some embodiments, the polypeptide sequence of the engineered DNA polymerase polypeptide comprises at least a substitution or substitution set at amino acid position 40/132/157/262/263/403/404/521/524/542/555/748/762/764, 40/132/157/262/263/404/521/524/542/589/748/762/764, 40/132/157/262/263/521/524/542/581/748/762/764, 40/132/157/262/263/521/542/748/762/764, 40/132/157/262/263/404/521/542/748/762, 40/132/157/262/263/521/748/750/849, 40/132/157/262/263/521/524/581/748, 16/40/132/157/262/263/521/735/748, 40/132/157/262/263/521/748/820, 40/132/157/262/263/521/748/793, 40/132/157/262/263/521/748/764, 40/132/157/262/263/521/748/755, 40/132/157/262/263/521/748/753, 40/132/157/262/263/521/735/748, 40/132/157/262/263/521/748/728, 40/132/157/262/263/521/704/748, 40/132/157/262/263/521/675/748, 40/132/157/262/263/521/671/748, 40/132/157/262/263/521/570/748, 40/132/157/262/263/495/521/748, 40/132/157/262/263/480/521/748, 40/132/157/262/263/476/521/748, 40/132/157/262/263/384/521/748, 40/132/157/262/263/322/521/748, 40/132/157/262/263/321/521/748, 40/132/157/243/262/263/521/748, 15/40/132/157/262/263/521/748, 40/102/132/157/262/263/521/748, 40/91/132/157/262/263/521/748, 40/87/132/157/262/263/521/748, 40/85/132/157/262/263/521/748, 20/40/132/157/262/263/521/748, 21/40/132/157/262/263/521/748, or 40/52/132/157/262/263/521/748, wherein the amino acid positions are relative to the reference sequence of SEQ ID NO: 2.

In some embodiments, the polypeptide sequence of the engineered DNA polymerase polypeptide comprises at least a substitution or substitution set at amino acid position 40/102/132/157/262/263/476/521/748, 40/102/132/157/262/263/495/521/748, 40/102/132/157/262/263/521/748/750, 21/40/52/102/132/157/262/263/521/748, 21/40/102/132/157/262/263/322/521/748, 20/40/102/132/157/262/263/322/521/748, 20/40/102/132/157/262/263/476/521/748, 40/85/102/132/157/262/263/521/748/750, 40/102/132/157/262/263/386/495/521/748, 40/102/132/157/262/263/476/495/521/748, 40/102/132/157/262/263/322/495/521/748/820, 40/102/132/157/262/263/386/521/748/849, 20/40/52/85/102/132/157/262/263/521/748, 40/102/132/157/262/263/476/521/748/750, 40/102/132/157/262/263/495/521/748/820, 40/102/132/157/262/263/521/748/750/820, 21/40/52/102/132/157/262/263/521/572/748, 20/40/102/132/157/262/263/322/386/521/748, 21/40/102/132/157/262/263/322/495/521/748, 40/85/102/132/157/262/263/322/476/521/748, 20/40/102/132/157/262/263/386/476/521/748, 21/40/102/132/157/262/263/322/521/748/750, 21/40/102/132/157/262/263/495/521/748/820, 20/40/102/132/157/262/263/495/521/748/820, 40/85/102/132/157/262/263/476/521/748/849, 21/40/102/132/157/262/263/521/748/820/849, 40/102/132/157/262/263/322/386/495/521/748, 40/102/132/157/262/263/273/322/521/748/849, 40/102/132/157/262/263/476/495/521/748/750, 40/102/132/157/262/263/322/521/748/750/820, 40/102/132/157/262/263/386/521/748/750/849, 21/40/85/102/132/157/262/263/322/521/748/820, 20/40/85/102/132/157/262/263/476/521/748/750, 20/40/85/102/132/157/262/263/495/521/748/849, 20/40/85/102/132/157/262/263/521/566/748/820, 40/52/102/132/157/262/263/322/498/521/748/750, 21/40/102/132/157/262/263/322/386/521/748/820, 40/52/102/132/157/262/263/386/495/521/748/820, 20/40/102/132/157/262/263/322/476/521/748/820, 40/85/102/132/157/262/263/386/495/521/748/750, 40/85/102/132/157/262/263/476/495/521/748/820, 40/85/102/132/157/262/263/322/521/748/750/820, 40/85/102/132/157/262/263/322/386/521/748/750/820, 21/40/102/132/157/262/263/322/495/521/748, 20/21/40/85/102/132/157/262/263/322/476/495/521/748, 20/40/102/132/157/262/263/299/322/386/476/495/521/748, 40/52/102/132/157/262/263/476/495/521/566/748/750/849, 20/40/85/102/132/157/262/200/263/322/476/495/521/748/750, or 21/40/85/102/132/157/262/263/322/386/495/521/748/820/849, wherein the amino acid positions are relative to the reference sequence of SEQ ID NO: 2.

In some embodiments, the polypeptide sequence of the engineered DNA polymerase polypeptide comprises at least a substitution or substitution set at amino acid position 40/85/102/132/157/262/263/299/386/521/566/748/750/820, 40/85/102/132/157/262/263/476/521/748/750/820/849, 21/40/85/102/132/157/262/263/322/476/495/521/748/750/820, 40/85/102/132/157/262/177/263/521/748/750, 21/40/85/102/132/157/262/263/495/521/748/750, 40/85/102/132/157/262/263/476/521/748/750/820, 20/40/52/85/102/132/157/262/263/299/521/748/750, 52/40/85/102/132/157/262/263/299/521/748/750, 40/85/102/132/157/262/263/322/521/748/750/820, 20/40/85/102/132/157/262/263/521/748/750/820, 20/40/85/102/132/157/262/263/299/386/476/521/748/750, 40/85/102/132/157/262/263/386/476/521/748/750/820, 40/85/102/132/157/262/263/476/495/521/748/750/820, 40/85/102/132/157/262/263/386/476/495/521/748/750, 20/21/40/85/102/132/157/262/263/299/322/386/521/748/750, 40/85/102/132/157/262/263/322/386/495/521/748/750, 21/40/85/102/132/157/262/263/299/322/476/495/521/748/750/820, 21/40/85/102/132/157/262/263/299/386/521/748/750/820, 40/85/102/132/157/262/263/299/476/521/748/750/820, 20/21/40/85/102/132/157/262/263/521/748/750, 21/40/102/132/157/262/263/521/748, 40/85/102/132/157/262/263/521/705/748/750, 21/40/85/102/132/157/262/263/386/476/521/748/750/820, 40/85/102/132/157/262/263/521/748/750/820, 21/40/85/102/132/157/262/263/299/322/521/748/750, 20/40/85/102/132/157/262/263/322/386/521/748/750/820, 40/85/102/132/157/262/263/299/521/748/750, 21/40/85/102/132/157/262/263/299/386/476/521/748/750, 40/85/102/109/132/157/262/263/521/748/750, 40/85/102/132/157/262/263/322/495/521/748/750, 40/85/102/132/157/262/263/491/521/748/750, 40/52/85/102/132/157/262/263/521/748/750/820, 21/40/85/102/132/157/262/263/386/521/748/750/820, 20/21/40/85/102/132/157/262/263/495/521/748/750, 21/40/85/102/132/157/262/263/299/322/495/521/566/748/750/820, 20/21/40/85/102/132/157/262/263/299/495/521/748/750, 40/85/102/132/157/262/263/521/748/750/756, 40/85/102/132/157/262/263/386/521/748/750/820, 40/85/102/132/157/262/263/495/521/748/750, 40/85/102/132/157/262/263/511/521/748/750, 21/40/52/85/102/132/157/262/263/242/386/495/521/748/750/820, 40/85/102/132/157/262/263/299/476/495/521/748/750, 40/85/102/132/157/262/263/521/706/748/750, 21/40/85/102/132/157/262/263/299/386/476/495/521/748/750, 21/40/85/102/132/157/262/263/299/322/495/521/748/750, 21/40/85/102/132/157/262/263/476/521/748/750/849, 40/85/102/132/157/262/263/299/322/476/521/748/750/820, 21/40/52/85/102/132/157/262/263/299/322/521/748/750/820, 20/21/40/85/102/132/157/262/263/521/566/748/750, 20/40/52/85/102/132/157/262/263/521/748/750, 40/85/102/132/157/262/263/322/386/495/521/566/748/750/820, 21/40/85/102/132/157/262/263/299/521/748/750, 21/40/85/102/132/157/262/263/299/386/521/748/750, 40/85/102/132/157/262/263/386/521/748/750/849, 40/52/85/102/132/157/262/263/476/521/748/750, 40/52/85/

102/132/157/262/263/299/322/386/495/521/748/750, or 40/85/102/132/157/262/263/440/521/748/750, wherein the amino acid positions are relative to the reference sequence of SEQ ID NO: 2.

In some embodiments, an engineered DNA polymerase of the present disclosure comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606.

In some embodiments, an engineered DNA polymerase of the present disclosure comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606, wherein the polypeptide sequence comprises one or more substitutions relative to the reference sequence corresponding to residues 12 to 850 of SEQ ID NO: 8, 332, 462, or 606, or to the reference sequence corresponding to SEQ ID NO: 8, 332, 462, or 606.

In some embodiments, the polypeptide sequence of the engineered DNA polymerase with the sequence identity above to a reference sequence comprising residues 12 to 850 of SEQ ID NO: 8, 332, 462, or 606, or to a reference sequence of SEQ ID NO: 8, 332, 462, or 606, comprises at least a substitution at amino acid position 15, 16, 20, 21, 22, 40, 41, 52, 57, 58, 73, 85, 87, 88, 91, 102, 109, 132, 157, 177, 186, 200, 213, 217, 231, 232, 242, 243, 262, 263, 264, 265, 273, 299, 321, 322, 328, 384, 386, 401, 402, 403, 404, 406, 407, 440, 476, 480, 491, 495, 498, 503, 504, 506, 507, 508, 511, 514, 520, 521, 523, 524, 525, 526, 527, 528, 529, 530, 533, 534, 535, 536, 537, 538, 539, 540, 542, 553, 554, 555, 556, 557, 558, 559, 560, 562, 563, 566, 570, 572, 581, 582, 584, 585, 586, 587, 589, 592, 593, 594, 595, 596, 597, 599, 601, 602, 603, 605, 607, 616, 665, 671, 674, 675, 677, 684, 688, 696, 704, 705, 706, 728, 735, 747, 748, 749, 750, 751, 753, 755, 756, 762, 763, 764, 766, 772, 773, 779, 793, 803, 814, 820, or 849, or combinations thereof, wherein the amino acid positions are relative to the reference sequence of SEQ ID NO: 8, 332, 462, or 606.

In some embodiments, the polypeptide sequence of the engineered DNA polymerase comprises at least an amino acid residue 15A/G/K/N, 16R, 20A/C, 21K/Q/S, 22K, 40A, 41F, 52R, 57T, 58N, 73A, 85E/P/R/S, 87N, 88T, 91K, 102V/M/S, 109P, 132Y, 157G, 177T, 186E, 200V, 213P, 217E, 231E, 232C, 242Q, 243L/S, 262L, 263A, 264T, 265I, 273M, 299N, 321G, 322N/S, 328I, 384Y, 386V, 401 A/G/I, 402G/R, 403L/R, 404S/T, 406K/Q, 407R/W, 440G, 476I/N, 480E/V/W, 491G, 495E/M/S, 498D, 503I/V, 504M, 506P, 507K, 508H, 511M, 514F, 520P, 521G/W/Y, 523A/K/V, 524G/K/Q, 525L/V, 526T, 527V/W, 528A/Q/R/W, 529S, 530G/P/R/W, 533L/P/Q/V, 534H/W, 535K, 536R, 537G/L/W, 538A, 539L/R, 540H/V, 542G/M/T/W, 553F/K/N/R, 554E, 555H/K/M/W, 556F/M/P/W, 557G/H, 558R/S/V/Q, 559D/G/P, 560G/M, 562S, 563L, 566A, 570R, 572I, 581A, 582F, 584N, 585KR, 586M, 587Q/S, 589G/L/R/S/W, 592G/T/V, 593N, 594C/Q/T/V/W, 595A/P/R, 596L/R/W, 597E, 599G/S/T, 601M/P, 602V, 603G/V/W, 605E/A, 607N, 616A, 665V, 671E/R, 674T, 675L, 677M, 684V, 688I, 696H/V, 704P, 705W, 706E, 728K, 735G/L, 747T, 748Y, 749L/R/T, 750S/P, 751H, 753K/V, 755P, 756N/T, 762M/Q/V, 763G/Y, 764A/I/V, 766Y, 772I, 773R, 779I, 793G, 803C/R, 814E, 820A, or 849T, or combinations thereof, wherein the amino acid positions are relative to the reference sequence of SEQ ID NO: 8, 332, 462, or 606.

In some embodiments, the polypeptide sequence of the engineered DNA polymerase comprises at least a substitution at amino acid position 40, 85, 102, 132, 157, 177, 262, 263, 521, 748, or 750, or combinations thereof.

In some embodiments, an engineered DNA polymerase of the present disclosure comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, or to a reference sequence corresponding to SEQ ID NO: 8, wherein the polypeptide sequence comprises one or more substitutions relative to the reference sequence corresponding to residues 12 to 850 of SEQ ID NO: 8, or to the reference sequence corresponding to SEQ ID NO: 8.

In some embodiments, the polypeptide sequence of the engineered DNA polymerase comprises at least a substitution or substitution set at amino acid position: 22/407, 328, 401, 402, 403, 404, 406, 407, 503, 504, 506, 521, 523, 524, 525, 526, 527, 528, 529, 530, 531, 533, 534, 535, 536, 537, 538, 539, 540, 542, 553, 554, 555, 556, 557, 558, 559, 560, 563, 581, 582, 585, 586, 587, 589, 592, 592, 592, 593, 594, 595, 596, 597, 598, 599, 601, 602, 603, 605, 607, 696, 747, 749, 751, 762, 763, 764, 766, 773, or 803, or combinations thereof, wherein the amino acid positions are relative to the reference sequence of SEQ ID NO: 8.

In some embodiments, an engineered DNA polymerase of the present disclosure comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 332, or to a reference sequence corresponding to SEQ ID NO: 332, wherein the polypeptide sequence comprises one or more substitutions relative to the reference sequence corresponding to residues 12 to 850 of SEQ ID NO: 332, or to the reference sequence corresponding to SEQ ID NO: 332.

In some embodiments, the polypeptide sequence of the engineered DNA polymerase comprises at least a substitution or substitution set at amino acid position 15, 20, 21, 52, 85, 87, 91, 102, 243, 321, 322, 384, 404, 476, 480, 480, 495, 542, 570, 671, 675, 704, 728, 735, 753, 755, 762, 764, 793, 820, 16/735, 750/849, 524/581, 403/404/524/542/555/762/764, 404/524/542/589/762/764, 524/542/581/762/764, or 542/762/764, wherein the amino acid positions are relative to the reference sequence of SEQ ID NO: 332.

In some embodiments, an engineered DNA polymerase of the present disclosure comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 462, or to a reference sequence corresponding to SEQ ID NO: 462, wherein the polypeptide sequence comprises one or more substitutions relative to the reference sequence corresponding to residues 12 to 850 of SEQ ID NO: 462, or to the reference sequence corresponding to SEQ ID NO: 462.

In some embodiments, the polypeptide sequence of the engineered DNA polymerase comprises at least a substitution or substitution set at amino acid position 750/820, 21/52, 20/21/85/322/476/495, 20/85/200/322/476/495/750, 476/750, 20/476, 20/322/386, 85/322/476, 52/322/498/750, 20/322/476/820, 85/476/495/820, 21/85/322/820, 20/299/ 322/386/476/495/820, 20/322, 21/820/849, 476, 322/820, 21/322/386/820, 322/386/495, 85/386/495/750, 20/85/476/ 750, 20/386/476, 85/322/386/476/495, 20/495/820, 750, 21/322/495, 52/386/495/820, 21/322, 85/322/750/820, 20/52/85, 21/52/572, 20/85/495/849, 85/750, 21/495/820, 273/322/849, 495, 322/750/820, 52/476/495/566/750/849, 386/495, 495/820, 21/322/495/750/820, 21/85/322/386/495/ 820/849, 476/495/750, 386/849, 476/495, 85/476/849, 21/322/750, 20/85/566/820, or 386/750/849, wherein the amino acid positions are relative to the reference sequence of SEQ ID NO: 462.

In some embodiments, an engineered DNA polymerase of the present disclosure comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 606, or to a reference sequence corresponding to SEQ ID NO: 606, wherein the polypeptide sequence comprises one or more substitutions relative to the reference sequence corresponding to residues 12 to 850 of SEQ ID NO: 606, or to the reference sequence corresponding to SEQ ID NO: 606.

In some embodiments, the polypeptide sequence of the engineered DNA polymerase comprises at least a substitution or substitution set at amino acid position 299/386/566/ 820, 476/820/849, 21/322/476/495/820, 177, 21/495, 476/ 820, 20/52/299, 52/299, 322/820, 20/820, 20/299/386/476, 386/476/820, 476/495/820, 386/476/495, 20/21/299/322/ 386, 322/386/495, 21/299/322/476/495/820, 21/299/386/ 820, 299/476/820, 20/21, 21/85/102/750, 705, 21/386/476/ 820, 820, 21/299/322, 20/21/322/386/820, 299, 21/299/386/ 476, 109, 322/495, 491, 52/820, 21/386/820, 20/21/495, 21/299/322/495/566/820, 20/21/299/495, 756, 386/820, 495, 511, 21/52/242/386/495/820, 299/476/495, 706, 21/299/386/476/495, 21/299/322/495, 21/476/849, 299/322/ 476/820, 21/52/299/322/820, 20/21/566, 20/52, 322/386/ 495/566/820, 21/299, 21/299/386, 386/849, 52/476, 52/299/ 322/386/495, 440, or combinations thereof, wherein the amino acid positions are relative to the reference sequence of SEQ ID NO: 606.

In some embodiments, the engineered DNA polymerase comprises a polypeptide sequence comprising a substitution or substitution set provided in Table 4.1, 5.1, 6.1, 7.1, and 8.1, wherein the substitution or substitution set is relative to the reference sequence of SEQ ID NO: 2, 8, 332, 462, or 606.

In some embodiments, the DNA polymerases comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence comprising residues 12 to 850 of at least one engineered DNA polymerase variant set forth in Table 4.1, 5.1, 6.1, 7.1, and 8.1, or to a reference sequence of at least one engineered variant set forth in Table 4.1, 5.1, 6.1, 7.1, and 8.1.

In some embodiments, the engineered DNA polymerase comprises a polypeptide sequence comprising residues 12 to 850 of a sequence selected from even-numbered sequences of SEQ ID NOS: 4-770, wherein the polypeptide optionally has 1, 2, 3, 4, 5, 6, 7, 8, 9, or up to 10 substitutions in the polypeptide sequence.

In some embodiments, the engineered DNA polymerase comprises a polypeptide sequence comprising a sequence selected from even-numbered sequences of SEQ ID NOS: 4-770, wherein the polypeptide optionally has 1, 2, 3, 4, 5, 6, 7, 8, 9, or up to 10 substitutions in the polypeptide sequence.

In some embodiments, the engineered DNA polymerase comprises a polypeptide sequence comprising a sequence comprising residues 12 to 850 of SEQ ID NO: 8, 332, 462, or 606, or a sequence comprising SEQ ID NO: 8, 332, 462, or 606.

In some embodiments, the engineered DNA polymerase has DNA polymerase activity. In some embodiments, the engineered DNA polymerase has at least one improved property as compared to a reference DNA polymerase. In some embodiments, the engineered DNA polymerase exhibits increased activity or produces a greater product yield in polymerase chain reaction compared to a reference DNA polymerase. In some embodiments, the engineered DNA polymerase exhibits increased fidelity compared to the reference DNA polymerase. In some embodiments, the engineered DNA polymerase exhibits increased thermostability compared to the reference DNA polymerase. In some embodiments, the engineered DNA polymerase exhibits increased processivity than the comparator DNA polymerase. In some embodiments, the reference or comparator DNA polymerase is a DNA polymerase having a sequence corresponding to residues 12 to 850 of SEQ ID NO: 2, 8, 332, 462, or 606; or a DNA polymerase having a sequence corresponding to SEQ ID NO: 2, 8, 332, 462, or 606. In some embodiments, the reference or comparator DNA polymerase is a DNA polymerase having a sequence corresponding to residues 12 to 850 of SEQ ID NO: 2; or a DNA polymerase having a sequence corresponding to SEQ ID NO: 2. In some embodiments, the reference or comparator DNA polymerase is a wild-type DNA polymerase selected from Pfu DNA polymerase from *Pyrococcus furiosus*, Group B DNA polymerase from *Thermococcus* sp. strain 2319x1, and Taq DNA polymerase from *Thermus aquaticus*.

In some further embodiments, the engineered DNA polymerase is purified. In some embodiments, the engineered DNA polymerase is provided in solution, or is immobilized on a substrate, such as surfaces of solid substrates or membranes or particles.

In another aspect, the present disclosure provides recombinant polynucleotides encoding any of the engineered DNA polymerases disclosed herein. In some embodiments, the recombinant polynucleotide encodes an engineered DNA polymerase, or a functional fragment thereof, comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 2, 8, 332, 462, or 606, or to a reference sequence corresponding to SEQ ID NO: 2, 8, 332, 462, or 606, wherein the polypeptide sequence comprises one or more substitutions relative to the reference sequence corresponding to residues 12 to 850 of SEQ ID NO: 2, 8, 332, 462, or 606, or to the reference sequence corresponding to SEQ ID NO: 2, 8, 332, 462, or 606.

In some embodiments, the recombinant polynucleotide encodes an engineered DNA polymerase, or a functional fragment thereof, comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 2 or to the reference sequence corresponding to SEQ ID NO: 2, wherein the polypeptide sequence comprises one or more substitutions relative to the reference sequence corresponding to residues 12 to 850 of SEQ ID NO: 2, or to the reference sequence corresponding to SEQ ID NO:2, as described above and herein.

In some embodiments, the recombinant polynucleotide comprises a sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference polynucleotide sequence corresponding to nucleotide residues 34 to 2550 of SEQ ID NO: 1, 5, 21, 23, 25, 27, or 823, or to a reference sequence corresponding to SEQ ID NO: 1, 5, 21, 23, 25, 27, or 823, wherein the polynucleotide encodes an engineered DNA polymerase. In some embodiments, the recombinant polynucleotide comprises a sequence comprising nucleotide residues 34 to 2550 of SEQ ID NO: 1, 5, 21, 23, 25, 27, or 823. In some embodiments, the recombinant polynucleotide comprises a sequence comprising SEQ ID NO: 1, 5, 21, 23, 25, 27, or 823.

In some embodiments, the recombinant polynucleotide comprises a sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to nucleotide residues 34 to 2550 of an odd numbered polynucleotide sequence selected from SEQ ID NOS: 3-769, wherein the polynucleotide encodes an engineered DNA polymerase. In some embodiments, the recombinant polynucleotide comprises a sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to an odd numbered polynucleotide sequence selected from SEQ ID NOS: 3-769, wherein the polynucleotide encodes an engineered DNA polymerase.

In some embodiments, the recombinant polynucleotide comprises a sequence comprising nucleotide residues 34 to 2550 of an odd numbered polynucleotide sequence selected from SEQ ID NOS: 3-769. In some embodiments, the recombinant polynucleotide comprises a sequence comprising an odd numbered polynucleotide sequence selected from SEQ ID NOS: 3-769.

In some embodiments, the polynucleotide sequence is codon optimized for expression in an organism, for example bacterial cells or mammalian cells. In some embodiments, the polynucleotide sequence is operably linked to a control sequence.

In a further aspect, the present disclosure provides expression vectors comprising at least one polynucleotide sequence provided herein encoding an engineered DNA polymerase. In some embodiments, the recombinant polynucleotide encoding an engineered DNA polymerase is operable linked to a control sequence. In some embodiments, the control sequence comprises a promoter.

In a further aspect, the present disclosure also provides host cells transformed with at least one recombinant polynucleotide or expression vector provided herein. In some embodiments, the host cell is a prokaryotic cell or eukaryotic cell. In some embodiments, the host cell is a bacterial, fungal, or mammalian cell. In some embodiments, the host cell is a bacterial cell, such as E. coli. or B. subtilis.

In another aspect, the present disclosure provide a method of producing an engineered DNA polymerase polypeptide in a host cell, the method comprising culturing a host cell provided herein, under suitable culture conditions such that at least one engineered DNA polymerase is produced. In some embodiments, the methods further comprise recovering the engineered DNA polymerase from the culture and/or host cells. In some embodiments, the methods further comprise the step of purifying the engineered DNA polymerase.

In another aspect, the present disclosure provides compositions comprising at least one engineered DNA polymerase disclosed herein. In some embodiments, the composition comprises at least a buffer. In some embodiments, the composition further comprises one or more DNA polymerase substrates, for example, nucleotide substrates and/or oligonucleotide primer substrate. In some embodiments, the composition further comprises a DNA template, such as a target DNA.

In a further aspect, the present disclosure provides use of the engineered DNA polymerase in methods of preparing a complementary DNA copy of a target DNA, whole or in part. In some embodiments, the present disclosure provides a method of preparing a complementary DNA of a target DNA, whole or in part, comprising contacting a target DNA with an engineered DNA polymerase described herein in presence of appropriate substrates under conditions suitable for DNA polymerase mediated production of a DNA complementary to the target DNA.

In some embodiments, the engineered DNA polymerase is used to detect a target DNA, the method comprising contacting a sample suspected of containing a target DNA with an engineered DNA polymerase of the present disclosure in presence of appropriate substrates under conditions suitable for DNA polymerase mediated production of a DNA complementary to the target DNA, whole or in part, and detecting presence of the complementary DNA. In some embodiments, the sample is a biological sample. In some embodiments, detecting the complementary DNA is by amplifying the complementary DNA, such as by polymerase chain reaction (PCR) or LAMP. In some embodiments, the engineered DNA polymerase can be used with a reverse transcriptase to detect a target RNA, such as by RT-PCR.

In a further aspect, the present disclosure also provides kits comprising at least one engineered DNA polymerase disclosed herein. In some embodiments, the kits can further comprises one or more of a buffer, nucleotide substrate, and/or oligonucleotide primer substrate. In some embodiments, the kit further comprises a template DNA. In some embodiments, the kits can include a second DNA polymerase, for example another thermostable DNA polymerase or a reverse transcriptase.

DETAILED DESCRIPTION

The present disclosure provides engineered DNA polymerase polypeptides and compositions thereof, as well as polynucleotides encoding the engineered DNA polymerase polypeptides. The disclosure also provides methods for using of the engineered DNA polymerase polypeptides and compositions thereof for diagnostic and other purposes. In some embodiments, the engineered DNA polymerase polypeptides provide enhanced polymerization activity, high replication fidelity, and/or high processivity particularly under conditions involving low concentrations of DNA input, high-throughput analysis, and/or sequencing reaction conditions.

In some embodiments, the engineered DNA polymerases of the present disclosure find use in diagnostic and research applications using small amounts of DNA from samples, including cell-free DNA, circulating tumor DNA, DNA isolated from circulating tumor cells, circulating fetal DNA, DNA isolated from virally infected cells, fine-needle aspirates, or single cells isolated by FACS (fluorescence activated cell sorting), laser-capture microscopy, or microfluidic devices. However, it is not intended that the sample used with the present invention be limited to any particular sample type, as any suitable sample, including those with low DNA concentrations, finds use with the present invention.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

As used herein, the singular "a", "an," and "the" include the plural references, unless the context clearly indicates otherwise.

As used herein, the term "comprising" and its cognates are used in their inclusive sense (i.e., equivalent to the term "including" and its corresponding cognates).

It is to be further understood that where description of embodiments use the term "comprising" and its cognates, the embodiments can also be described using language "consisting essentially of" or "consisting of."

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

As used herein, the term "DNA" refers to deoxyribonucleic acid.

As used herein, the term "RNA" refers to ribonucleic acid.

As used herein, the terms "fusion protein," and "chimeric protein" and "chimera" refer to hybrid proteins created through the joining of two or more genes that originally encoded separate proteins. In some embodiments, fusion proteins are created by recombinant technology (e.g., molecular biology techniques known in the art).

As used herein, the term "polymerase" refers to a class of enzymes that polymerize nucleoside triphosphates. Polymerases use a template nucleic acid strand to synthesize a complementary nucleic acid strand. The template strand and synthesized nucleic acid strand can independently be either DNA or RNA. Polymerases known in the art include but are not limited to DNA polymerases (e.g., *E. coli* DNA polI, *T. aquaticus* DNA polymerase (Taq), DNA-dependent RNA polymerases, and reverse transcriptases). As used herein, the polymerase is a polypeptide or protein containing sufficient amino acids to carry out a desired enzymatic function of the polymerase. In some embodiments, the polymerase does not contain all of the amino acids found in the native enzyme, but only those which are sufficient to allow the polymerase to carry out a desired catalytic activity, including but not limited to 5'-3' polymerization, 5'-3' exonuclease, and 3'-5' exonuclease activities.

As used herein, the term "DNA polymerase activity," "synthetic activity," and "polymerase activity" are used interchangeably herein, and refer to the ability of an enzyme to synthesize new DNA strands by the incorporation of deoxynucleoside triphosphates.

As used herein, the terms "duplex" and "ds" refer to a double-stranded nucleic acid (e.g., DNA) molecule comprised of two single-stranded polynucleotides that are complementary in their sequence (A pairs to T, C pairs to G), arranged in an antiparallel 5' to 3' orientation, and held together by hydrogen bonds between the nucleobases (i.e., adenine [A], guanine [G], cytosine [C], and thymine [T]).

As used here, the terms "protein," "polypeptide," and "peptide" are used interchangeably to denote a polymer of at least two amino acids covalently linked by an amide bond, regardless of length or post-translational modification (e.g., glycosylation or phosphorylation).

As used herein, the term "amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes. The abbreviations used for the genetically encoded amino acids are conventional and are as follows:

alanine (Ala or A), arginine (Arg or R), asparagine (Asn or N), aspartate (Asp or D), cysteine (Cys or C), glutamate (Glu or E), glutamine (Gln or Q), glycine (Gly or G), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V). When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

As used herein, the terms "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

As used herein, "coding sequence" refers to that part of a nucleic acid (e.g., a gene) that encodes an amino acid sequence of a protein.

As used herein, the term "percent (%) sequence identity" refers to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 1981, 2:482), by the homology alignment algorithm of Needleman and Wunsch (Needleman and Wunsch, J. Mol. Biol., 1970, 48:443), by the search for similarity method of Pearson and Lipman (Pearson and Lipman, Proc. Natl. Acad. Sci. USA, 1988, 85:2444), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms (See e.g., Altschul et al., J. Mol. Biol., 1990, 215: 403-410; and Altschul et al., Nucleic Acids Res., 1977, 3389-3402). Software for performing BLAST analyses is publicly available through the National Center for Biotechnology Information website. This algorithm involves first identifying high scoring sequence pairs (HSPs) by identifying short words of length "W" in the query sequence, which either match or satisfy some positive-valued threshold score "T," when aligned with a word of the same length in a database sequence. T is referred to as the neighborhood word score threshold (See, Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters "M" (reward score for a pair of matching residues; always >0) and "N" (penalty score for mismatching residues; always <0). For amino acid sequences, a scoring matrix is used to calculate the cumulative score. Extension of the word hits in each direction are halted when: the cumulative alignment score falls off by the quantity "X" from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA, 1989, 89:10915). Exemplary determination of sequence alignment and % sequence identity can employ the BESTFIT or GAP programs in the GCG Wisconsin Software package (Accelrys, Madison WI), using default parameters provided.

As used herein, "reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, the phrase "a reference sequence based on SEQ ID NO: 2, having a valine at the residue corresponding to X200" (or "a reference sequence based on SEQ ID NO: 2, having a valine at the residue corresponding to position 200") refers to a reference sequence in which the corresponding residue at position X200 in SEQ ID NO: 2 (e.g., an alanine), has been changed to valine.

As used herein, "comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to", "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered DNA polymerase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned. In some embodiments, the sequence is tagged (e.g., with a histidine tag).

As used herein, "mutation" refers to the alteration of a nucleic acid sequence. In some embodiments, mutations result in changes to the encoded polypeptide sequence (i.e., as compared to the original sequence without the mutation). In some embodiments, the mutation comprises a substitution, such that a different amino acid is produced (e.g., substitution of an aspartic acid with tryptophan). In some alternative embodiments, the mutation comprises an addition, such that an amino acid is added to the original polypeptide sequence. In some further embodiments, the mutation comprises a deletion, such that an amino acid is deleted from the original polypeptide sequence. Any number of mutations may be present in a given sequence.

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X200 as compared to SEQ ID NO: 2" (or a "residue difference at position 200 as compared to SEQ ID NO: 2") refers to a difference of the amino acid residue at the polypeptide position corresponding to position 200 of SEQ ID NO: 2. Thus, if the reference polypeptide of SEQ ID NO: 2 has an alanine at position 200, then a "residue difference at position X200 as compared to SEQ ID NO: 2" refers to an amino acid substitution of any residue other than alanine at the position of the polypeptide corresponding to position 200 of SEQ ID NO: 2. In most instances herein, the specific amino acid residue difference at a position is indicated as "XnY" where "Xn" specified the corresponding residue and position of the reference polypeptide (as described above), and "Y" is the single letter identifier of the amino acid found in the engineered polypeptide (i.e., the different residue than in the reference polypeptide). In some instances (e.g., in the Tables in the Examples), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X15A/X15G, X15A/G, or V15A/G or 15A/G). The present disclosure includes engineered polypeptide sequences comprising one or more amino acid differences that include either/or both conservative and non-conservative amino acid substitutions, as well as insertions and deletions of amino acids in the sequence.

As used herein, the terms "amino acid substitution set" and "substitution set" refers to a group of amino acid substitutions within a polypeptide sequence. In some embodiments, substitution sets comprise 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant DNA polymerase polypeptides listed in any of the Tables in the Examples. In these substitution sets, the individual substitutions are separated by a semicolon (";"; e.g., V15G; L20A;F21K) or slash ("/"; e.g., V15G/L20A/F21K or 15G/20A/21K). In some embodiments, the "substitution" comprises the deletion of an amino acid.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affect: (a) the structure of the peptide backbone in the area of the substitution (e.g., proline for glycine); (b) the charge or hydrophobicity; and/or (c) the bulk of the side chain. By way of example and not limitation, exemplary non-conservative substitutions include an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered polymerase enzyme. Deletions can be directed to the internal portions and/or terminal portions of the polypeptide. In various embodiments, the deletion can comprise a continuous segment or can be discontinuous. Deletions are indicated by "–", and may be present in substitution sets.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

As used herein, "functional fragment" and "biologically active fragment" are used interchangeably herein, to refer to a polypeptide that has an amino-terminal and/or carboxy-terminal deletion(s) and/or internal deletions, but where the remaining amino acid sequence is identical to the corresponding positions in the sequence to which it is being compared (e.g., a full length engineered DNA polymerase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant DNA polymerase polypeptides may be present within a cell, present in the cellular medium, or prepared in various forms, such as lysates or isolated preparations. As such, in some embodiments, the recombinant DNA polymerase polypeptides provided herein are isolated polypeptides.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure DNA polymerase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant DNA polymerase polypeptides are substantially pure polypeptide compositions.

As used herein, "improved enzyme property" refers to an engineered DNA polymerase polypeptide that exhibits an improvement in any enzyme property as compared to a reference DNA polymerase polypeptide, such as a wild-type DNA polymerase polypeptide (e.g., the wild-type DNA polymerase polypeptide sequence of residues 12 to 850 of SEQ ID NO: 2) or another engineered DNA polymerase polypeptide. Improved properties include but are not limited to such properties as increased protein expression, increased thermoactivity, increased thermostability, increased stability, increased enzymatic activity, increased substrate specificity and/or affinity, increased specific activity, increased resistance to substrate and/or end-product inhibition, increased chemical stability, improved chemoselectivity, improved solvent stability, increased tolerance to acidic pH, increased tolerance to proteolytic activity (i.e., reduced sensitivity to proteolysis), increased solubility, increased fidelity, increased processivity, and altered temperature profile.

As used herein, "increased enzymatic activity" and "enhanced catalytic activity" refer to an improved property of the engineered DNA polymerase polypeptides, which can be represented by an increase in specific activity (e.g., product produced/time/weight protein) and/or an increase in percent conversion of the substrate to the product (e.g., percent conversion of starting amount of substrate to product in a specified time period using a specified amount of DNA polymerase) as compared to the reference DNA polymerase enzyme (e.g., wild-type DNA polymerase and/or another engineered DNA polymerase). Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring DNA polymerase or another engineered DNA polymerase from which the DNA polymerase polypeptides were derived.

As used herein, the terms "proteolytic activity" and "proteolysis" used interchangeably herein refer to the breakdown of proteins into smaller polypeptides or amino acids. The breakdown of proteins is generally the result of hydrolysis of the peptide bond by protease (proteinase) enzymes. Protease enzymes include but are not limited to, pepsin, trypsin, chymotrypsin, elastase; carboxypeptidase A and B, and peptidases (e.g., amino peptidase, dipeptidase and enteropeptidase).

As used herein, the phrases "reducing sensitivity to proteolysis" and "reducing proteolytic sensitivity" are used interchangeably herein mean that an engineered DNA polymerase polypeptide according to the invention will have a higher enzyme activity compared to a reference DNA polymerase in a standard assay (e.g., as disclosed in the Examples) after treatment with one or more proteases.

As used herein, "conversion" refers to the enzymatic conversion (or biotransformation) of substrate(s) to the corresponding product(s). "Percent conversion" refers to the percent of the substrate that is converted to the product within a period of time under specified conditions. Thus, the "enzymatic activity" or "activity" of a DNA polymerase polypeptide can be expressed as "percent conversion" of the substrate to the product in a specific period of time.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition comprises hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is more efficiently expressed in that organism. Although the genetic code is degenerate, in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the DNA polymerase enzymes are codon optimized for optimal production from the host organism selected for expression.

As used herein, "control sequence" refers herein to include all components that are necessary or advantageous for the expression of a polynucleotide and/or polypeptide of the present disclosure. Each control sequence may be native or foreign to the nucleic acid sequence encoding the polypeptide. Such control sequences include, but are not limited to, leaders, polyadenylation sequences, propeptide sequences, promoter sequences, signal peptide sequences, initiation sequences, and transcription terminators. At a minimum, the control sequences include a promoter, and transcriptional and translational stop signals. In some embodiments, the control sequences are provided with linkers for the purpose of introducing specific restriction sites facilitating ligation of the control sequences with the coding region of the nucleic acid sequence encoding a polypeptide.

As used herein, "operably linked" refers to a configuration in which a control sequence is appropriately placed (i.e., in a functional relationship) at a position relative to a polynucleotide of interest such that the control sequence directs or regulates the expression of the polynucleotide encoding a polypeptide of interest.

As used herein, "promoter sequence" refers to a nucleic acid sequence that is recognized by a host cell for expression of a polynucleotide of interest, such as a coding sequence. The promoter sequence contains transcriptional control sequences that mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

As used herein, "suitable reaction conditions" or "suitable conditions" refers to those conditions in the enzymatic conversion reaction solution (e.g., ranges of enzyme loading, substrate loading, temperature, pH, buffers, co-solvents, etc.) under which a DNA polymerase polypeptide of the present disclosure is capable of converting a substrate to the desired product compound. Exemplary "suitable reaction conditions" are provided herein (See, the Examples).

As used herein, "loading", such as in "compound loading" or "enzyme loading" refers to the concentration or amount of a component in a reaction mixture at the start of the reaction. "Substrate" in the context of an enzymatic conversion reaction process refers to the compound or molecule acted on by the DNA polymerase polypeptide.

As used herein, "product" in the context of an enzymatic conversion process refers to the compound or molecule resulting from the action of the DNA polymerase polypeptide on the substrate.

As used herein, "culturing" refers to the growing of a population of microbial cells under suitable conditions using any suitable medium (e.g., liquid, gel, or solid).

Recombinant polypeptides (e.g., DNA polymerase enzyme variants) can be produced using any suitable methods known the art. For example, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant DNA polymerase polypeptides" (also referred to herein as "engineered DNA polymerase polypeptides," "engineered DNA polymerases," "variant DNA polymerase enzymes," and "DNA polymerase variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., a polynucleotide sequences encoding at least one DNA polymerase variant). In some embodiments, the host cells are prokaryotic or eukaryotic cells that have been transformed or transfected with vectors constructed using recombinant DNA techniques as known in the art.

As used herein, the term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues include non-naturally occurring amino acid residues including, but not limited to, homoarginine, ornithine and norvaline, as well as naturally occurring amino acids. In some embodiments, analogues also include one or more D-amino acid residues and non-peptide linkages between two or more amino acid residues.

As used herein, the term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "cell-free DNA" refers to DNA circulating freely in the bloodstream and is not contained by or associated with cells. In some embodiments, cell-free DNA comprises DNA originally derived and released from normal somatic or germ line cells, cancer cells, fetal cells, microbial cells, or viruses.

As used herein, "amplification" refers to nucleic acid replication. In some embodiments, the term refers to replication of specific template nucleic acid.

As used herein, "polymerase chain reaction" and "PCR" refer to the methods described in U.S. Pat. Nos. 4,683,195 and 4,6884,202, hereby incorporated by reference. These methods find use in increasing the concentration of a segment of a target sequence or an entire target sequence in a mixture or purified DNA, without cloning or purification being required. The sequence of denaturation, annealing and extension constitute a "cycle." The steps of denaturing, primer annealing, and polymerase extension can be repeated many times (i.e., multiple cycles are used), to obtain a high concentration of amplified DNA. The process is well-known in the art and numerous variations have been developed over the years since the method was first described. With PCR, it is possible to amplify a single copy of a specific target sequence to a level that is detectable by several different methodologies, including but not limited to hybridization with a labeled probe, incorporation of biotinylated primers followed by avidin-enzyme conjugate detection, incorporation of $^{32}$P-labeled deoxyribonucleotide triphosphates (e.g., dCTP or dATP) into the amplified segment, etc. In addition to genomic DNA, any oligonucleotide sequence amenable to amplification can be copies using PCR with an appropriate set of primers. PCR products can also serve as templates for amplification.

As used herein, "target" when used in reference to a method employing a DNA polymerase, refers to the region of nucleic acid for preparation of a complementary DNA. The "target" is sorted out from other nucleic acids present in the methods using a DNA polymerase. In some embodiments, a "segment" is a region of nucleic acid within the target sequence.

As used herein, "target DNA" when used in context of a DNA polymerase refers to the DNA, all or a portion thereof, that is the object for preparation of a complementary DNA copy. The target DNA can be the whole of the DNA sequence or a portion thereof, such as a segment of the DNA sequence.

As used herein, "target RNA" refers to the RNA, all or a portion thereof, that is the object for preparation of a complementary DNA copy. The target RNA can be the whole of the RNA sequence or a portion thereof, such as a segment of the RNA sequence.

As used herein, "sample template" refers to nucleic acid originating from a sample which is analyzed for the presence of target nucleic acid. In contrast, "background template" refers to nucleic acid other than sample template that may or may not be present within a sample. Background template may be inadvertently included in the sample, it may result from carryover, or may be due to the presence of nucleic acid contaminants from which the target nucleic acid is purified. For example, in some embodiments, nucleic acids from organisms other than those to be detected may be present as background in a test sample. However, it is not intended that the present invention be limited to any specific nucleic acid samples or templates.

As used herein, "amplifiable nucleic acid" is used in reference to nucleic acids which may be amplified by any amplification method, including but not limited to PCR. In most embodiments, amplifiable nucleic acids comprise sample templates.

As used herein, "PCR product", "PCR fragment," and "amplification product" refer to the resultant compounds obtained after two or more cycles of PCR amplification (or other amplification method, as indicated by the context), typically comprising the steps of denaturation, annealing, and extension. The terms encompass the situation wherein there has been amplification of one or more segments of one or more target sequences.

As used herein, "amplification reagents" and "PCR reagents" refer to those reagents (e.g., deoxyribonucleotide triphosphates, buffer, etc.), needed for amplification except for the primers, nucleic acid template, and the amplification enzyme. Typically, amplification reagents, along with other reaction components are placed and contained in a reaction vessel (e.g., test tube, microwell, etc.). It is not intended that the present invention be limited to any specific amplification reagents, as any suitable reagents find use in the present invention.

As used herein, "primer" refers to an oligonucleotide (i.e., a sequence of nucleotides), whether occurring naturally or produced synthetically, recombinantly, or by amplification, which is capable of acting as a point of initiation of nucleic acid synthesis, when placed under conditions in which synthesis of a primer extension product that is complementary to a nucleic acid strand is induced (i.e., in the presence of nucleotides and an inducing agent such as DNA polymerase, and at a suitable temperature and pH). In most embodiments, primers a single-stranded, but in some embodiments, they are double-stranded. In some embodiments, the primers are of sufficient length to prime the synthesis of extension products in the presence of DNA polymerase. The exact primer length depends upon many factors, as known to those skilled in the art.

As used herein, "probe" refers to an oligonucleotide (i.e., a sequence of nucleotides), whether occurring naturally or produced synthetically, recombinantly, or by amplification, which is capable of hybridizing to another oligonucleotide of interest. Probes find use in the detection, identification, and/or isolation of particular gene sequences of interest. In some embodiments, probes are labeled with a "reporter molecule" (also referred to as a "label") that aids in the detection of the probe in a suitable detection system (e.g., fluorescent, radioactive, luminescent, enzymatic, and other systems). It is not intended that the present invention be limited to any particular detection system or label. Primers, deoxyribonucleotides, and deoxyribonucleosides may contain labels. Indeed, it is not intended that the labeled composition of the present invention be limited to any particular component. Illustrative labels include, but are not limited to $^{32}P$, $^{35}S$, and fluorescent molecules (e.g., fluorescent dyes, including but not limited to green fluorescent protein).

As used herein, "fidelity," when used in reference to a polymerase is intended to refer to the accuracy of template-directed incorporation of complementary bases in a synthesized DNA strand relative to the template strand. Typically, fidelity is measured based on the frequency of incorporation of incorrect bases in the newly synthesized nucleic acid strand. The incorporation of incorrect bases can result in point mutations, insertions, or deletions. Fidelity can be calculated according to any method known in the art (See e.g., Tindall and Kunkel, Biochem., 1988, 27:6008-6013; and Barnes, Gene, 1992, 112:29-35). A polymerase or polymerase variant can exhibit either high fidelity or low fidelity. As used herein, "high fidelity" refers to polymerases with a frequency of accurate base incorporation that exceeds a predetermined value. As used herein, the term "low fidelity" refers to polymerases with a frequency of accurate base incorporation that is lower than a predetermined value. In some embodiments, the predetermined value is a desired frequency of accurate base incorporation or the fidelity of a known polymerase (i.e., a reference polymerase).

As used herein, "altered fidelity" refers to the fidelity of a polymerase variant that differs from the fidelity of the parent polymerase from which the polymerase variant was derived. In some embodiments, the altered fidelity is higher than the fidelity of the parent polymerase, while in some other embodiments, the altered fidelity is lower than the fidelity of the parent polymerase. Altered fidelity can be determined by assaying the parent and variant polymerases and comparing their activities using any suitable assay known in the art.

As used herein, the term "processivity" refers to the ability of a nucleic acid modifying enzyme, such as a DNA polymerase, to remain bound to the template or substrate and perform multiple modification reactions. Processivity is generally measured by the number of catalytic events that take place per binding event.

As used herein, "altered processivity" refers to the processivity of polymerase, or variants thereof that differ from the processivity of the parent polymerase from which the variant was derived. In some embodiments, the altered processivity is higher than the processivity of the parent enzyme, while in some other embodiments, the altered processivity is lower than the processivity of the parent enzyme. Altered processivity can be determined by assaying the parent and variant enzymes and comparing their activities using any suitable assay known in the art.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

As used herein, the term "sample" refers to a material or substance for reaction with a DNA polymerase, for example, such as for detecting presence of a target nucleic acid or preparing a DNA copy of a target nucleic acid for sequencing or generation of cDNA libraries. In some embodiments, the sample is a "biological sample," which refers to sample of biological tissue or fluid. Such samples are typically from humans, but include tissues isolated from non-human primates, or rodents, e.g., mice, and rats, and includes sections of tissues such as biopsy and autopsy samples, frozen sections taken for histological purposes, blood, plasma, serum, sputum, stool, tears, mucus, hair, skin, etc. A "biological sample" also refers to a cell or population of cells or a quantity of tissue or fluid from organisms. In some embodiments, the biological sample has been removed from an animal, but the term "biological sample" can also refer to cells or tissue analyzed in vivo, i.e., without removal from the animal. Typically, a "biological sample" will contain cells from the animal or of organisms, but the term can also refer to noncellular biological material, such as noncellular fractions of blood, saliva, or urine. Numerous types of biological samples can be used with the enzymes, compositions, and method in the present disclosure, including, but not limited to, a tissue biopsy, a blood sample, a buccal scrape, a saliva sample, or a nipple discharge. As used herein, a "tissue biopsy" refers to an amount of tissue removed from an animal, preferably a human, for diagnostic analysis. In a patient with cancer, tissue may be removed from a tumor, allowing the analysis of cells within the tumor. "Tissue biopsy" can refer to any type of biopsy, such as needle biopsy, fine needle biopsy, surgical biopsy, etc.

Engineered DNA Polymerase Polypeptides

The present disclosure provides DNA polymerase polypeptide variants engineered to have improved properties. In some embodiments, the engineered DNA polymerase polypeptide variants are useful in performing polymerase reactions, including preparing a complementary DNA of a target DNA target/template. The engineered DNA polymerase variants find use in the efficient creation of complementary DNA from DNA templates, whole or in part, such as in sequencing (e.g., NGS sequencing), amplification (e.g., PCR), and diagnostic methods, such as for detecting a target nucleic acid. These engineered DNA polymerase variants can be used in solution, as well as in immobilized embodiments. In some embodiments, the engineered DNA polymerase can prepared and used as non-fusion polypeptides or as fusion polypeptides.

In some embodiments herein, when a particular DNA polymerase variant (i.e., an engineered DNA polymerase polypeptide) is referred to by reference to modification of particular amino acid residues in the sequence of a wild-type DNA polymerase or reference DNA polymerase polypeptide, it is to be understood that variants of another DNA polymerase modified in the equivalent position(s) (as determined from the optional amino acid sequence alignment between the respective amino acid sequences) are encompassed herein. For example, for a substitution at specified amino acid position(s) numbered in reference to SEQ ID: 2, an equivalent amino acid position(s) can be readily ascertained for another reference sequence, such as a reference sequence comprising residues 12 to 850 of SEQ ID NO: 2, 8, 332, 462, or 606, or such as a reference sequence of SEQ ID NO: 8, 332, 462, or 606.

In one aspect, the present disclosure provides an engineered DNA polymerase, or a functional fragment thereof, comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 2, 8, 332, 462, or 606, or to a reference sequence corresponding to SEQ ID NO: 2, 8, 332, 462, or 606, wherein the polypeptide sequence comprises one or more substitutions relative to the reference sequence corresponding to residues 12 to 850 of SEQ ID NO: 2, 8, 332, 462, or 606, or to the reference sequence corresponding to SEQ ID NO: 2, 8, 332, 462, or 606.

In some embodiments, an engineered DNA polymerase, or a functional fragment thereof, comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 850 of SEQ ID NO: 2 or to the reference sequence corresponding to SEQ ID NO: 2, wherein the polypeptide sequence comprises one or more substitutions relative to the reference sequence corresponding to residues 12 to 850 of SEQ ID NO: 2, or to the reference sequence corresponding to SEQ ID NO: 2.

In some embodiments, the engineered DNA polymerase, or a functional fragment thereof, comprises a polypeptide sequence having at least 80% or more sequence identity to the reference sequence corresponding to residues 12 to 850 of SEQ ID NO: 2, or to the reference sequence corresponding to SEQ ID NO: 2, wherein the polypeptide sequence comprises one or more substitutions relative to the reference sequence corresponding to residues 12 to 850 of SEQ ID NO: 2, or to the reference sequence corresponding to SEQ ID NO: 2.

In some embodiments, the engineered DNA polymerase, or a functional fragment thereof, comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the reference sequence corresponding to residues 12 to 850 of SEQ ID NO: 8, 332, 462, or 606 or to the reference sequence corresponding to SEQ ID NO: 8, 332, 462, or 606, wherein the polypeptide sequence comprises one or more substitutions relative to the reference sequence corresponding to residues 12 to 850 of SEQ ID NO: 2, or to the reference sequence corresponding to SEQ ID NO: 2.

In some embodiments, the engineered DNA polymerase, or a functional fragment thereof, comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of an engineered DNA polymerase variant set forth in Table 4.1, 5.1, 6.1, 7.1, and 8.1, or to a reference sequence corresponding to an engineered DNA polymerase variant set forth in Table 4.1, 5.1, 6.1, 7.1, and 8.1, wherein the polypeptide sequence comprises one or more substitutions relative to the reference sequence corresponding to residues 12 to 850 of SEQ ID NO: 2, or to the reference sequence corresponding to SEQ ID NO: 2.

In some embodiments, the polypeptide sequence of the engineered DNA polymerase comprises at least a substitution at amino acid position 15, 16, 20, 21, 22, 40, 41, 52, 57, 58, 73, 85, 87, 88, 91, 102, 109, 132, 157, 177, 186, 200, 213, 217, 231, 232, 242, 243, 262, 263, 264, 265, 273, 299, 321, 322, 328, 384, 386, 401, 402, 403, 404, 406, 407, 440, 476, 480, 491, 495, 498, 503, 504, 506, 507, 508, 511, 514, 520, 521, 523, 524, 525, 526, 527, 528, 529, 530, 533, 534, 535, 536, 537, 538, 539, 540, 542, 553, 554, 555, 556, 557, 558, 559, 560, 562, 563, 566, 570, 572, 581, 582, 584, 585, 586, 587, 589, 592, 593, 594, 595, 596, 597, 599, 601, 602, 603, 605, 607, 616, 665, 671, 674, 675, 677, 684, 688, 696, 704, 705, 706, 728, 735, 747, 748, 749, 750, 751, 753, 755, 756, 762, 763, 764, 766, 772, 773, 779, 793, 803, 814, 820, 849, or combinations thereof, wherein the amino acid positions are relative to the reference sequence of SEQ ID NO: 2.

In some embodiments, the polypeptide sequence of the engineered DNA polymerase comprises at least a substitution 15A/G/K/N, 16R, 20A/C, 21K/Q/S, 22K, 40A, 41F, 52R, 57T, 58N, 73A, 85E/P/R/S, 87N, 88T, 91K, 102V/M/S, 109P, 132Y, 157G, 177T, 186E, 200V, 213P, 217E, 231E, 232C, 242Q, 243L/S, 262L, 263A, 264T, 265I, 273M, 299N, 321G, 322N/S, 328I, 384Y, 386V, 401 A/G/I, 402G/R, 403L/R, 404S/T, 406K/Q, 407R/W, 440G, 476I/N, 480E/V/

W, 491G, 495E/M/S, 498D, 503I/V, 504M, 506P, 507K, 508H, 511M, 514F, 520P, 521G/W/Y, 523A/K/V, 524G/K/Q, 525L/V, 526T, 527V/W, 528A/Q/R/W, 529S, 530G/P/R/W, 533L/P/Q/V, 534H/W, 535K, 536R, 537G/L/W, 538A, 539L/R, 540H/V, 542G/M/T/W, 553F/K/N/R, 554E, 555H/K/M/W, 556F/M/P/W, 557G/H, 558R/S/V/Q, 559D/G/P, 560G/M, 562S, 563L, 566A, 570R, 572I, 581A, 582F, 584N, 585KR, 586M, 587Q/S, 589G/L/R/S/W, 592G/T/V, 593N, 594C/Q/T/V/W, 595A/P/R, 596L/R/W, 597E, 599G/S/T, 601M/P, 602V, 603G/V/W, 605E/A, 607N, 616A, 665V, 671E/R, 674T, 675L, 677M, 684V, 688I, 696H/V, 704P, 705W, 706E, 728K, 735G/L, 747T, 748Y, 749L/R/T, 750S/P, 751H, 753K/V, 755P, 756N/T, 762M/Q/V, 763G/Y, 764A/I/V, 766Y, 772I, 773R, 779I, 793G, 803C/R, 814E, 820A, 849T, or combinations thereof, wherein the amino acid positions are relative to the reference sequence of SEQ ID NO: 2.

In some embodiments, the polypeptide sequence of the engineered DNA polymerase comprises at least a substitution V15A/G/K/N, Q16R, L20A/C, F21K/Q/S, Q22K, S40A, Y41F, S52R, V57T, H58N, E73A, P85E/P/R/S, P87N, S88T, H91K, S102V/M/S, K109P, V132Y, S157G, R177T, Q186E, A200V, R213P, A217E, D231E, R232C, P242Q, P243L/S, I262L, S263A, R264T, M265I, V273M, T299N, E321G, R322N/S, V328I, R384Y, R386V, S401A/G/I, N402G/R, N403L/R, Q404S/T, A406K/Q, S407R/W, E440G, L476I/N, Q480E/V/W, A491G, R495E/M/S, G498D, L503I/V, N504M, R506P, D507K, Q508H, T511M, Y514F, A520P, A521G/W/Y, R523A/K/V, R524G/K/Q, T525L/V, A526T, K527V/W, T528A/Q/R/W, G529S, K530G/P/R/W, T533L/P/Q/V, S534H/W, A535K, S536R, V537G/L/W, L538A, E539L/R, T540H/V, R542G/M/T/W, Q553F/K/N/R, Y554E, R555H/K/M/W, E556F/M/P/W, L557G/H, A558R/S/V/Q, K559D/G/P, L560G/M, G562S, T563L, D566A, K570R, V572I, T581A, R582F, H584N, Q585K/R, T586M, G587Q/S, A589G/L/R/S/W, R592G/T/V, L593N, S594C/Q/T/V/W, S595A/P/R, S596L/R/W, D597E, N599G/S/T, Q601M/P, N602V, I603G/V/W, I605E/A, T607N, G616A, M665V, V671E/R, D674T, P675L, R677M, I684V, V688I, R696H/V, D704P, Y705W, G706E, R728K, E735G/L, R747T, H748Y, V749L/R/T, P750S/P, E751H, L753K/V, K755P, A756N/T, A762M/Q/V, A763G/Y, E764A/I/V, V766Y, V772I, Q773R, L779I, P793G, H803C/R, R814E, R820A, A849T, or combinations thereof, wherein the amino acid positions are relative to the reference sequence of SEQ ID NO: 2.

In some embodiments, the polypeptide sequence of the engineered DNA polymerase comprises at least a substitution at amino acid position 40, 85, 102, 132, 157, 177, 262, 263, 521, 748, or 750, or combinations thereof, wherein the amino acid positions are relative to the reference sequence of SEQ ID NO: 2. In some embodiments, the polypeptide sequence of the engineered DNA polymerase comprises at least a substitution at amino acid position 40. In some embodiments, the polypeptide sequence of the engineered DNA polymerase comprises at least a substitution at amino acid position 85. In some embodiments, the polypeptide sequence of the engineered DNA polymerase comprises at least a substitution at amino acid position 102. In some embodiments, the polypeptide sequence of the engineered DNA polymerase comprises at least a substitution at amino acid position 132. In some embodiments, the polypeptide sequence of the engineered DNA polymerase comprises at least a substitution at amino acid position 157. In some embodiments, the polypeptide sequence of the engineered DNA polymerase comprises at least a substitution at amino acid position 177. In some embodiments, the polypeptide sequence of the engineered DNA polymerase comprises at least a substitution at amino acid position 262. In some embodiments, the polypeptide sequence of the engineered DNA polymerase comprises at least a substitution at amino acid position 263. In some embodiments, the polypeptide sequence of the engineered DNA polymerase comprises at least a substitution at amino acid position 503. In some embodiments, the polypeptide sequence of the engineered DNA polymerase comprises at least a substitution at amino acid position 521. In some embodiments, the polypeptide sequence of the engineered DNA polymerase comprises at least a substitution at amino acid position 748. In some embodiments, the polypeptide sequence of the engineered DNA polymerase comprises at least a substitution at amino acid position 750.

In some embodiments, the polypeptide sequence of the engineered DNA polymerase comprises at least a substitution at amino acid positions 40, 132, 157, 262, 263, or 748. In some embodiments, the polypeptide sequence of the engineered DNA polymerase comprises at least a substitution at amino acid position 40, 132, 157, 262, 263, 503, and 748. In some embodiments, the polypeptide sequence of the engineered DNA polymerase comprises at least a substitution at amino acid position 40, 102, 132, 157, 262, 263, 521, or 748. In some embodiments, the polypeptide sequence of the engineered DNA polymerase comprises at least a substitution at amino acid position 40, 85, 102, 132, 157, 177, 262, 263, 521, 748, or 750.

In some embodiments, the polypeptide sequence of the engineered DNA polymerase comprises at least a substitution 40A, 85E/P/R/S, 102V/M/S, 132Y, 157G, 177T, 262L, 263A, 521G/W/Y, 748Y, or 750S/P, or combinations thereof, wherein the amino acid positions are relative to the reference sequence of SEQ ID NO:2. In some embodiments, the polypeptide sequence of the engineered DNA polymerase comprises at least a substitution S40A, P85E/P/R/S, S102V/M/S, V132Y, S157G, R177T, I262L, S263A, A521G/W/Y, H748Y, or P750S, or combinations thereof. In some embodiments, for the engineered DNA polymerase comprising one or more substitutions at amino acid positions 40, 85, 102, 132, 157, 262, 263, 521, 748, or 750, the substitutions can be selected from the foregoing, e.g., 40A, 85E/P/R/S, 102V/M/S, 132Y, 157G, 177T, 262L, 263A, 521G/W/Y, 748Y, and/or 750S/P. In some embodiments, the polypeptide sequence of the engineered DNA polymerase comprises at least a substitution 40A, 85E, 102S, 132Y, 157G, 177T, 262L, 263A, 521G, 748Y, or 750S, or combinations thereof.

In some embodiments, the polypeptide sequence of the engineered DNA polymerase comprises at least a substitution or substitution set at amino acid position 213/503/508/584/748, 40/132/748, 40/132/157/262/263/748, 132, 40/132/503/748, 40/132/157/503/562, 40/132/213/748/814, 132/157/562/584, 132/584/748, 40/132/231/684/748, 40/132, 40/41/132/562/684/748, 41/213/231/503/650/674/748, 132/231/503/748, 40/132/157/503, 503/748/814, 40/132/231/503/674/748, 40/88/132/503/684/748, 132/157/213/674/748/814, 157/263/748, 40/748, 41/157/231/262/748/814, 40/213/503/562/584/748, 523/524, 40/132/503/514/650/674, 40/132/157/213/231, 41/213/520/814, 40/41/157/231/503, 40/157/503, 40/132/562/748, 132/748, 40/41/132/562/748, 88/213/503/584/684/748, 57/58/523/616/677, 40/213/231/503/514/562/748, 132/562, 213/503/650, 40/41/88/231/748/814, 41/213/262/562, 41/88/231/748, 213/263/748, 40/157/213, 157/520, 40/132/263/503/674/814, 40/41, 524/665/756, 58/186/217/523/524/677, 40/41/748, 132/514, 520, 41/213/503/562, 231/503/748/772, 503/562, 73/232/514/584/814, 58/507/616, 132/262/520/562/684/748, 88/562/814, 41/88/157/814, 88/157/213/674/684, 57/58/ 523/779, 40/132/157/514/520/684, 40/41/213/684/772, 40/41/231/503/814, 88/213/503/584/814, 40/41/132/562/ 584, 41/88/213/231/503/650/748, 40/503, 40/132/213/231/ 520/562/650/814, 40/41/132/231/262/503/562/584/748/ 814, 57/58/264/265/524/688, 88/132/157/262/263/520/562, 88/132/157/262/503/514/562/650, 40/584/674/748, 40/41/ 132/263/503, 584/748, 40/213/674, 40/41/88T/132/503/ 562/584/748, 88/213/514/562/748/814, 263/520/814, or 40/41/88/157, wherein the amino acid positions are relative to the reference sequence of SEQ ID NO: 2.

In some embodiments, the polypeptide sequence of the engineered DNA polymerase comprises at least a substitution or substitution set 213P/503I/508H/584N/748Y; 40A/ 132Y/748Y; 40A/132Y/157G/262L/263A/748Y; 132Y; 40A/132Y/503I/748Y; 40A/132Y/157G/503I/562S; 40A/ 132Y/213P/748Y/814E; 132Y/157G/562S/584N; 132Y/ 584N/748Y; 40A/132Y/231E/684V/748Y; 40A/132Y; 40A/ 41F/132Y/562S/684V/748Y; 41F/213P/231E/503I/650A/ 674T/748Y; 132Y/231E/503I/748Y; 40A/132Y/157G/503I; 503I/748Y/814E; 40A/132Y/231E/503I/674T/748Y; 40A/ 88T/132Y/503I/684V/748Y; 132Y/157G/213P/674T/748Y/ 814E; 157G/263A/748Y; 40A/748Y; 41F/157G/231E/262L/ 748Y/814E; 40A/213P/503I/562S/584N/748Y; 523K/524K; 40A/132Y/503I/514F/650A/674T; 40A/132Y/157G/213P/ 231E; 41F/213P/520P/814E; 40A/41F/157G/231E/503I; 40A/157G/503I; 40A/132Y/562S/748Y; 132Y/748Y; 40A/ 41F/132Y/562S/748Y; 88T/213P/503I/584N/684V/748Y; 57T/58N/523K/616A/677M; 40A/213P/231E/503I/514F/ 562S/748Y; 132Y/562S; 213P/503I/650A; 40A/41F/88T/ 231E/748Y/814E; 41F/213P/262L/562S; 41F/88T/231E/ 748Y; 213P/263A/748Y; 40A/157G/213P; 157G/520P; 40A/132Y/263A/503I/674T/814E; 40A/41F; 524K/665V/ 756N; 58N/186E/217E/R523K/R524K/R677M; S40A/ Y41F/748Y; 132Y/514F; 520P; 41F/213P/503I/562S; 231E/ 503I/748Y/772I; 503I/562S; 73A/232C/514F/584N/814E; 58N/507K/616A; 132Y/262L/520P/562S/684V/748Y; 88T/ 562S/814E; 41F/88T/157G/814E; 88T/157G/213P/674T/ 684V; 57T/58N/523K/779I; 40A/132Y/157G/514F/520P/ 684V; 40A/41F/213P/684V/772I; 40A/41F/231E/503I/ 814E; 88T/213P/503I/584N/814E; 40A/41F/132Y/562S/ 584N; 41F/88T/213P/231E/503I/650A/748Y; 40A/503I; 40A/132Y/213P/231E/520P/562S/650A/814E; 40A/41F/ 132Y/231E/262L/503I/562S/584N/748Y/814E; 57T/58N/ 264T/265I/524K/688I; 88T/132Y/157G/262L/263A/520P/ 562S; 88T/132Y/157G/262L/503I/514F/562S/650A; 40A/ 584N/674T/748Y; 40A/41F/132Y/263A/503I; 584N/748Y; 40A/213P/674T; 40A/41F/88T/132Y/503I/562S/584N/ 748Y; 88T/213P/514F/562S/748Y/814E; 263A/520P/814E; 40A/41F/88T/157G; or combinations thereof, wherein the amino acid positions are relative to the reference sequence of SEQ ID NO: 2.

In some embodiments, the polypeptide sequence of the engineered DNA polymerase comprises at least a substitution or substitution set R213P/L503I/Q508H/H584N/ H748Y; S40A/V132Y/H748Y; S40A/V132Y/S157G/I262L/ S263A/H748Y; V132Y; S40A/V132Y/L503I/H748Y;S40A/ V132Y/S157G/L503I/G562S; S40A/V132Y/R213P/ H748Y/R814E; V132Y/S157G/G562S/H584N; V132Y/ H584N/H748Y; S40A/V132Y/D231E/I684V/H748Y; S40A/V132Y; S40A/Y41F/V132Y/G562S/I684V/H748Y; Y41F/R213P/D231E/L503I/I650A/D674T/H748Y; V132Y/ D231E/L503I/H748Y; S40A/V132Y/S157G/L503I; L503I/ H748Y/R814E; S40A/V132Y/D231E/L503I/D674T/ H748Y; S40A/S88T/V132Y/L503I/I684V/H748Y; V132Y/ S157G/R213P/D674T/H748Y/R814E; S157G/S263A/ H748Y; S40A/H748Y; Y41F/S157G/D231E/I262L/H748Y/ R814E; S40A/R213P/L503I/G562S/H584N/H748Y; R523K/R524K; S40A/V132Y/L503I/Y514F/I650A/D674T; S40A/V132Y/S157G/R213P/D231E; Y41F/R213P/A520P/ R814E; S40A/Y41F/S157G/D231E/L503I; S40A/S157G/ L503I; S40A/V132Y/G562S/H748Y; V132Y/H748Y; S40A/Y41F/V132Y/G562S/H748Y; S88T/R213P/L503I/ H584N/I684V/H748Y; V57T/H58N/R523K/G616A/ R677M; S40A/R213P/D231E/L503I/Y514F/G562S/ H748Y; V132Y/G562S; R213P/L503I/I650A; S40A/Y41F/ S88T/D231E/H748Y/R814E; Y41F/R213P/I262L/G562S; Y41F/S88T/D231E/H748Y; R213P/S263A/H748Y; S40A/ S157G/R213P; S157G/A520P; S40A/V132Y/S263A/ L503I/D674T/R814E; S40A/Y41F; R524K/M665V/ A756N; H58N/Q186E/A217E/R523K/R524K/R677M; S40A/Y41F/H748Y; V132Y/Y514F; A520P; Y41F/R213P/ L503I/G562S; D231E/L503I/H748Y/V772I; L503I/G562S; E73A/R232C/Y514F/H584N/R814E; H58N/D507K/ G616A; V132Y/I262L/A520P/G562S/I684V/H748Y; S88T/G562S/R814E; Y41F/S88T/S157G/R814E; S88T/ S157G/R213P/D674T/I684V; V57T/H58N/R523K/L779I; S40A/V132Y/S157G/Y514F/A520P/I684V; S40A/Y41F/ R213P/I684V/V772I; S40A/Y41F/D231E/L503I/R814E; S88T/R213P/L503I/H584N/R814E; S40A/Y41F/V132Y/ G562S/H584N; Y41F/S88T/R213P/D231E/L503I/I650A/ H748Y; S40A/L503I; S40A/V132Y/R213P/D231E/A520P/ G562S/I650A/R814E; S40A/Y41F/V132Y/D231E/I262L/ L503I/G562S/H584N/H748Y/R814E; V57T/H58N/R264T/ M265I/R524K/V688I; S88T/V132Y/S157G/I262L/S263A/ A520P/G562S; S88T/V132Y/S157G/I262L/L503I/Y514F/ G562S/I650A; S40A/H584N/D674T/H748Y; S40A/Y41F/ V132Y/S263A/L503I; H584N/H748Y; S40A/R213P/ D674T; S40A/Y41F/S88T/V132Y/L503I/G562S/H584N/ H748Y; S88T/R213P/Y514F/G562S/H748Y/R814E; S263A/A520P/R814E; S40A/Y41F/S88T/S157G; or combinations thereof, wherein the amino acid positions are relative to the reference sequence of SEQ ID NO: 2.

In some embodiments, the polypeptide sequence of the engineered DNA polymerase comprises at least a substitution or substitution set at amino acid position 22/407, 328, 401, 402, 403, 404, 406, 407, 503, 504, 506, 521, 523, 524, 525, 526, 527, 528, 529, 530, 531, 533, 534, 535, 536, 537, 538, 539, 540, 542, 553, 554, 555, 556, 557, 558, 559, 560, 563, 581, 582, 585, 586, 587, 589, 592, 592, 592, 593, 594, 595, 596, 597, 598, 599, 601, 602, 603, 605, 607, 696, 747, 749, 751, 762, 763, 764, 766, 773, 803, or combinations thereof, wherein the amino acid positions are relative to the reference sequence of SEQ ID NO: 2.

In some embodiments, the polypeptide sequence of the engineered DNA polymerase comprises at least a substitution or substitution set 599S, 530G, 596L, 696H, 542W, 530R, 553F, 533V, 555M, 594V, 594W, 536R, 585K, 401G, 597E, 553K, 402R, 763Y, 762V, 605E, 530P, 506P, 589G, 558S, 553N, 559P, 751H, 589S, 747T, 560M, 696V, 540V, 594C, 556W, 589R, 407W, 557H, 559G, 599T, 521Y, 605A, 559D, 534H, 592G, 533P, 529S, 524G, 749R, 766Y, 556P, 595P, 533Q, 603V, 537G, 589W, 598W, 22K/407R, 555W, 539R, 531Q, 581A, 803R, 538A, 404T, 406Q, 537L, 595R, 534W, 404S, 592V, 521W, 603G, 401I, 595A, 762Q, 530W, 558V, 527W, 596W, 603W, 528W, 504M, 587Q, 587S, 523V, 521G, 558R, 558Q, 593N, 525V, 749L, 503V, 527V, 554E, 535K, 592T, 528A, 585R, 401A, 586M, 764I, 556M, 763G, 406K, 582F, 540H, 560G, 402G, 594Q, 539L, 602V, 523A, 749T, 542T, 764A, 523K, 607N, 525L, 403L, 526T, 528R, 599G, 537W, 803C, 556F, 557G, 601M, 596R, 563L, 601P, 773R, 553R, 542M, 594T, 533L, 328I, 555K, 542G, or 528Q, or combinations thereof, wherein the amino acid positions are relative to the reference sequence of SEQ ID NO: 2.

In some embodiments, the polypeptide sequence of the engineered DNA polymerase comprises at least a substitution or substitution set N599S, K530G, S596L, R696H, R542W, K530Q, Q553F, T533V, R555M, S594V, S594W, S536R, Q585K, S401G, D597E, Q553K, N402R, A763Y, A762V, I605E, K530P, R506P, A589G, A558S, Q553N, K559P, E751H, A589S, R747T, L560M, R696V, T540V, S594C, E556W, A589R, S407W, L557H, K559G, N599T, A521Y, I605A, K559D, S534H, R592G, T533P, G529S, R524G, V749R, V766Y, E556P, S595P, T533Q, I603V, V537G, A589W, P598W, Q22K/S407R, R555W, E539R, R531Q, T581A, H803R, L538A, Q404T, A406Q, V537L, S595R, S534W, Q404S, R592V, A521W, I603G, S401I, S595A, A762Q, K530W, A558V, K527W, S596W, I603W, T528W, N504M, G587Q, G587S, R523V, A521G, A558R, A558Q, L593N, T525V, V749L, L503V, K527V, Y554E, A535K, R592T, T528A, Q585R, S401A, T586M, E764I, E556M, A763G, A406K, R582F, T540H, L560G, N402G, S594Q, E539L, N602V, R523A, V749T, R542T, E764A, R523K, T607N, T525L, N403L, A526T, T528R, N599G, V537W, H803C, E556F, L557G, Q601M, S596R, T563L, Q601P, Q773R, Q553R, R542M, S594T, T533L, V328I, R555K, R542G, T528Q, or combinations thereof, wherein the amino acid positions are relative to the reference sequence of SEQ ID NO: 2.

In some embodiments, the polypeptide sequence of the engineered DNA polymerase comprises at least a substitution or substitution set at amino acid position 15, 20, 21, 52, 85, 87, 91, 102, 243, 321, 322, 384, 404, 476, 480, 480, 495, 542, 570, 671, 675, 704, 728, 735, 753, 755, 762, 764, 793, 820, 16/735, 750/849, 524/581, 403/404/524/542/555/762/764, 404/524/542/589/762/764, 524/542/581/762/764, 542/762/764, wherein the amino acid positions are relative to the reference sequence of SEQ ID NO: 2.

In some embodiments, the polypeptide sequence of the engineered DNA polymerase comprises at least a substitution or substitution set 404S, 542G, 762M, 524Q/542G/581A/762M/764V, 404S/524Q/542G/589L/762M/764V, 764V, 403R/404S/524Q/542G/555H/762M/764V, 476N, 542G/762M/764V, 728K, 52R, 476I, 675L, 750S/849T, 102S, 21C, 755P, 21S, 321G, 20A, 21K, 87N, 20C, 16R/735L, 21Q, 704P, 735G, 384Y, 480W, 102M, 793G, 322S, 322N, 570R, 480V, 753V, 753K, 524Q/581A, 91K, 243L, 243S, 671E, 85S, 495M, 15A, 15N, 15K, 820A, 495E, 85E, 85R, 480E, 15G, or 671R, wherein the amino acid positions are relative to the reference sequence of SEQ ID NO: 2.

In some embodiments, the polypeptide sequence of the engineered DNA polymerase comprises at least a substitution or substitution set Q404S, R542G, A762M, R524Q/R542G/T581A/A762M/E764V, Q404S/R524Q/R542G/A589L/A762M/E764V, E764V, N403R/Q404S/R524Q/R542G/R555H/A762M/E764V, L476N, R542G/A762M/E764V, R728K, S52R, L476I, P675L, P750S/A849T, V102S, F21C, K755P, F21S, E321G, L20A, F21K, P87N, L20C, Q16R/E735L, F21Q, D704P, E735G, R384Y, Q480W, V102M, P793G, R322S, R322N, K570R, Q480V, L753V, L753K, R524Q/T581A, H91K, P243L, P243S, V671E, P85S, R495M, V15A, V15N, V15K, R820A, R495E, P85E, P85R, Q480E, V15G, or V671R, wherein the amino acid positions are relative to the reference sequence of SEQ ID NO: 2.

In some embodiments, the polypeptide sequence of the engineered DNA polymerase comprises at least a substitution or substitution set at amino acid position 750/820, 21/52, 20/21/85/322/476/495, 20/85/200/322/476/495/750, 476/750, 20C/476, 20/322/386, 85/322/476, 52/322/498/750, 20/322/476/820, 85/476/495/820, 21/85/322/820, 20/299/322/386/476/495/820, 20/322, 21/820/849, 476, 322/820, 21/322/386/820, 322/386/495, 85/386/495/750, 20/85/476/750, 20/386/476, 85/322/386/476/495, 20/495/820, 750, 21/322/495, 52/386/495/820, 21/322, 85/322/750/820, 20/52/85, 21/52/572, 20/85/495/849, 85/750, 21/495/820, 273/322/849, 495, 322/750/820, 52/476/495/566/750/849, 386/495, 495/820, 21/322/495/750/820, 21/85/322/386/495/820/849, 476/495/750, 386/849, 476/495, 85/476/849, 21/322/750, 20/85/566/820, or 386/750/849, wherein the amino acid positions are relative to the reference sequence of SEQ ID NO: 2.

In some embodiments, the polypeptide sequence of the engineered DNA polymerase comprises at least a substitution or substitution set 750S/820A, 21C/52R, 20C/21C/85E/322N/476N/495E, 20C/85E/200V/322N/476N/495S/750S, 476N/750S, 20C/476N, 20C/322N/386V, 85E/322N/476N, 52R/322N/498D/750S, 20C/322N/476N/820A, 85E/476N/495E/820A, 21C/85E/322N/820A, 20C/299N/322N/386V/476N/495E/820A, 20C/322N, 21C/820A/849T, 476N, 322N/820A, 21C/322N/386V/820A, 322N/386V/495E, 85E/386V/495E/750S, 20C/85E/476N/750S, 20C/386V/476N, 85E/322N/386V/476N/495S, 20C/495E/820A, 750S, 21C/322N/495E, 52R/386V/495S/820A, 21C/322N, 85E/322N/750S/820A, 20C/52R/85E, 21C/52R/572I, 20C/85E/495E/849T, 85E/750S, 21C/495E/820A, 273M/322N/849T, 495E, 322N/750S/820A, 52R/476N/495E/566A/750S/849T, 386V/495E, 495S/820A, 21C/322N/495E/750S/820A, 21C/85E/322N/386V/495S/820A/849T, 495S, 476N/495E/750S, 386V/849T, 476N/495E, 85E/476N/849T, 21C/322N/750S, 20C/85E/566A/820A, or 386V/750S/849T, wherein the amino acid positions are relative to the reference sequence of SEQ ID NO: 2.

In some embodiments, the polypeptide sequence of the engineered DNA polymerase comprises at least a substitution or substitution set P750S/R820A, F21C/S52R, L20C/F21C/P85E/R322N/L476N/R495E, L20C/P85E/A200V/R322N/L476N/R495S/P750S, L476N/P750S, L20C/L476N, L20C/R322N/R386V, P85E/R322N/L476N, S52R/R322N/G498D/P750S, L20C/R322N/L476N/R820A, P85E/L476N/R495E/R820A, F21C/P85E/R322N/R820A, L20C/T299N/R322N/R386V/L476N/R495E/R820A, L20C/R322N, F21C/R820A/A849T, L476N, R322N/R820A, F21C/R322N/R386V/R820A, R322N/R386V/R495E, P85E/R386V/R495E/P750S, L20C/P85E/L476N/P750S, L20C/R386V/L476N, P85E/R322N/R386V/L476N/R495S, L20C/R495E/R820A, P750S, F21C/R322N/R495E, S52R/R386V/R495S/R820A, F21C/R322N, P85E/R322N/P750S/R820A, L20C/S52R/P85E, F21C/S52R/V572I, L20C/P85E/R495E/A849T, P85E/P750S, F21C/R495E/R820A, V273M/R322N/A849T, R495E, R322N/P750S/R820A, S52R/L476N/R495E/D566A/P750S/A849T, R386V/R495E, R495S/R820A, F21C/R322N/R495E/P750S/R820A, F21C/P85E/R322N/R386V/R495S/R820A/A849T, R495S, L476N/R495E/P750S, R386V/A849T, L476N/R495E, P85E/L476N/A849T, F21C/R322N/P750S, L20C/P85E/D566A/R820A, or R386V/P750S/A849T, wherein the amino acid positions are relative to the reference sequence of SEQ ID NO: 2.

In some embodiments, the polypeptide sequence of the engineered DNA polymerase comprises at least a substitution or substitution set at amino acid position 299/386/566/820, 476/820/849, 21/322/476/495/820, 177, 21/495, 476/820, 20/52/299, 52/299, 322/820, 20/820, 20/299/386/476, 386/476/820, 476/495/820, 386/476/495, 20/21/299/322/

386, 322/386/495, 21/299/322/476/495/820, 21/299/386/ 820, 299/476/820, 20/21, 21/85/102/750, 705, 21/386/476/ 820, 820, 21/299/322, 20/21/322/386/820, 299, 21/299/386/ 476, 109, 322/495, 491, 52/820, 21/386/820, 20/21/495, 21/299/322/495/566/820, 20/21/299/495, 756, 386/820, 495, 511, 21/52/242/386/495/820, 299/476/495, 706, 21/299/386/476/495, 21/299/322/495, 21/476/849, 299/322/ 476/820, 21/52/299/322/820, 20/21/566, 20/52, 322/386/ 495/566/820, 21/299, 21/299/386, 386/849, 52/476, 52/299/ 322/386/495, or 440, wherein the amino acid positions are relative to the reference sequence of SEQ ID NO: 2.

In some embodiments, the polypeptide sequence of the engineered DNA polymerase comprises at least a substitution or substitution set 299N/386V/566A/820A, 476N/ 820A/849T, 21C/322N/476N/495E/820A, 177T, 21C/495E, 476N/820A, 20C/52R/299N, 52R/299N, 322N/820A, 20C/ 820A, 20C/299N/386V/476N, 386V/476N/820A, 476N/ 495E/820A, 386V/476N/495E, 20C/21C/299N/322N/386V, 322N/386V/495E, 21C/299N/322N/476N/495E/820A, 21C/299N/386V/820A, 299N/476N/820A, 20C/21C, 21C/ 85P/102V/750P, 705W, 21C/386V/476N/820A, 820A, 21C/ 299N/322N, 20C/21C/322N/386V/820A, 299N, 21C/299N/ 386V/476N, 109P, 322N/495E, 491G, 52R/820A, 21C/ 386V/820A, 20C/21C/495E, 21C/T99N/322N/495E/566A/ 820A, 20C/21C/299N/495E, 756T, 386V/820A, 495E, 511M, 21C/52R/242Q/386V/495E/820A, 299N/476N/ 495E, 706E, 21C/299N/386V/476N/495E, 21C/299N/ 322N/495E, 21C/476N/849T, 299N/322N/476N/820A, 21C/52R/299N/322N/820A, 20C/21C/566A, 20C/52R, 322N/386V/495E/566A/820A, 21C/299N, 21C/299N/386V, 386V/849T, 52R/476N, 52R/299N/322N/386V/495E, or 440G, wherein the amino acid positions are relative to the reference sequence of SEQ ID NO: 2.

In some embodiments, the polypeptide sequence of the engineered DNA polymerase comprises at least a substitution or substitution set T299N/R386V/D566A/R820A, L476N/R820A/A849T, F21C/R322N/L476N/R495E/ R820A, R177T, F21C/R495E, L476N/R820A, L20C/S52R/ T299N, S52R/T299N, R322N/R820A, L20C/R820A, L20C/T299N/R386V/L476N, R386V/L476N/R820A, L476N/R495E/R820A, R386V/L476N/R495E, L20C/ F21C/T299N/R322N/R386V, R322N/R386V/R495E, F21C/T299N/R322N/L476N/R495E/R820A, F21C/T299N/ R386V/R820A, T299N/L476N/R820A, L20C/F21C, F21C/ E85P/S102V/S750P, Y705W, F21C/R386V/L476N/R820A, R820A, F21C/T299N/R322N, L20C/F21C/R322N/R386V/ R820A, T299N, F21C/T299N/R386V/L476N, K109P, R322N/R495E, A491G, S52R/R820A, F21C/R386V/ R820A, L20C/F21C/R495E, F21C/T299N/R322N/R495E/ D566A/R820A, L20C/F21C/T299N/R495E, A756T, R386V/R820A, R495E, T511M, F21C/S52R/P242Q/ R386V/R495E/R820A, T299N/L476N/R495E, G706E, F21C/T299N/R386V/L476N/R495E, F21C/T299N/R322N/ R495E, F21C/L476N/A849T, T299N/R322N/L476N/ R820A, F21C/S52R/T299N/R322N/R820A, L20C/F21C/ D566A, L20C/S52R, R322N/R386V/R495E/D566A/ R820A, F21C/T299N, F21C/T299N/R386V, R386V/ A849T, S52R/L476N, S52R/T299N/R322N/R386V/R495E, or E440G, wherein the amino acid positions are relative to the reference sequence of SEQ ID NO: 2.

In some embodiments, the polypeptide sequence of the engineered DNA polymerase comprises at least a substitution set at amino acid position: 22/40/132/157/262/263/407/ 748, 40/132/157/262/263/328/748, 40/132/157/262/263/ 401/748, 40/132/157/262/263/402/748, 40/132/157/262/ 263/403/748, 40/132/157/262/263/404/748, 40/132/157/ 262/263/406/748, 40/132/157/262/263/407/748, 40/132/ 157/262/263/503/748, 40/132/157/262/263/504/748, 40/132/157/262/263/506/748, 40/132/157/262/263/521/ 748, 40/132/157/262/263/523/748, 40/132/157/262/263/ 524/748, 40/132/157/262/263/525/748, 40/132/157/262/ 263/526/748, 40/132/157/262/263/527/748, 40/132/157/ 262/263/528/748, 40/132/157/262/263/529/748, 40/132/ 157/262/263/530/748, 40/132/157/262/263/531/748, 40/132/157/262/263/533/748, 40/132/157/262/263/534/ 748, 40/132/157/262/263/535/748, 40/132/157/262/263/ 536/748, 40/132/157/262/263/537/748, 40/132/157/262/ 263/538/748, 40/132/157/262/263/539/748, 40/132/157/ 262/263/540/748, 40/132/157/262/263/542/748, 40/132/ 157/262/263/54/748, 40/132/157/262/263/553/748, 40/132/ 157/262/263/554/748, 40/132/157/262/263/555/748, 40/132/157/262/263/556/748, 40/132/157/262/263/557/ 748, 40/132/157/262/263/558/748, 40/132/157/262/263/ 559/748, 40/132/157/262/263/560/748, 40/132/157/262/ 263/563/748, 40/132/157/262/263/581/748, 40/132/157/ 262/263/582/748, 40/132/157/262/263/585/748, 40/132/ 157/262/263/586/748, 40/132/157/262/263/587/748, 40/132/157/262/263/589/748, 40/132/157/262/263/592/ 748, 40/132/157/262/263/593/748, 40/132/157/262/263/ 594/748, 40/132/157/262/263/595/748, 40/132/157/262/ 263/596/748, 40/132/157/262/263/597/748, 40/132/157/ 262/263/598/748, 40/132/157/262/263/599/748, 40/132/ 157/262/263/601/748, 40/132/157/262/263/602/748, 40/132/157/262/263/603/748, 40/132/157/262/263/605/ 748, 40/132/157/262/263/607/748, 40/132/157/262/263/ 696/748, 40/132/157/262/263/747/748, 40/132/157/262/ 263/748, 40/132/157/262/263/748/749, 40/132/157/262/ 263/748/751, 40/132/157/262/263/748/762, 40/132/157/ 262/263/748/763, 40/132/157/262/263/748/764, 40/132/ 157/262/263/748/766, 40/132/157/262/263/748/773, 40/132/157/262/263/748/803, 40/132/157/605/262/263/ 748, 40/132/157/262/263/403/521/748, or 40/132/157/262/ 263/403/553/748, wherein the amino acid positions are relative to the reference sequence of SEQ ID NO: 2.

In some embodiments, the polypeptide sequence of the engineered DNA polymerase comprises at least a substitution set 40A/132Y/157G/262L/263A/599S/748Y, 40A/ 132Y/157G/262L/263A/530G/748Y, 40A/132Y/157G/ 262L/263A/596L/748Y, 40A/132Y/157G/262L/263A/ 696H/748Y, 40A/132Y/157G/262L/263A/542W/748Y, 40A/132Y/157G/262L/263A/530R/748Y, 40A/132Y/157G/ 262L/263A/553F/748Y, 40A/132Y/157G/262L/263A/ 533V/748Y, 40A/132Y/157G/262L/263A/555M/748Y, 40A/132Y/157G/262L/263A/594V/748Y, 40A/132Y/157G/ 262L/263A/594W/748Y, 40A/132Y/157G/262L/263A/ 536R/748Y, 40A/132Y/157G/262L/263A/585K/748Y, 40A/ 132Y/157G/262L/263A/401G/748Y, 40A/132Y/157G/ 262L/263A/597E/748Y, 40A/132Y/157G/262L/263A/ 553K/748Y, 40A/132Y/157G/262L/263A/402R/748Y, 40A/ 132Y/157G/262L/263A/748Y/763Y, 40A/132Y/157G/ 262L/263A/748Y/762V, 40A/132Y/157G/262L/263A/ 605E/748Y, 40A/132Y/157G/262L/263A/530P/748Y, 40A/ 132Y/157G/262L/263A/506P/748Y, 40A/132Y/157G/ 262L/263A/589G/748Y, 40A/132Y/157G/262L/263A/ 558S/748Y, 40A/132Y/157G/262L/263A/553N/748Y, 40A/ 132Y/157G/262L/263748Y, 40A/132Y/157G/262L/263A/ 748Y/751H, 40A/132Y/157G/262L/263A/589S/748Y, 40A/ 132Y/157G/262L/263A/747T/748Y, 40A/132Y/157G/ 262L/263A/560M/748Y, 40A/132Y/157G/262L/263A/ 696V/748Y, 40A/132Y/157G/262L/263A/540V/748Y, 40A/ 132Y/157G/262L/263A/594C/748Y, 40A/132Y/157G/ 262L/263A/556W/748Y, 40A/132Y/157G/262L/263A/ 589R/748Y, 40A/132Y/157G/262L/263A/407W/748Y, 40A/132Y/157G/262L/263A/557H/748Y, 40A/132Y/157G/

262L/263A/559G/748Y, 40A/132Y/157G/262L/263A/599T/748Y, 40A/132Y/157G/262L/263A/521Y/748Y, 40A/132Y/157G/605A/262L/263A/748Y, 40A/132Y/157G/262L/263A/559D/748Y, 40A/132Y/157G/262L/263A/534H/748Y, 40A/132Y/157G/262L/263A/592G/748Y, 40A/132Y/157G/262L/263A/533P/748Y, 40A/132Y/157G/262L/263A/529S/748Y, 40A/132Y/157G/262L/263A/524G/748Y, 40A/132Y/157G/262L/263A/748Y/749R, 40A/132Y/157G/262L/263A/748Y/766Y, 40A/132Y/157G/262L/263A/556P/748Y, 40A/132Y/157G/262L/263A/595P/748Y, 40A/132Y/157G/262L/263A/533Q/748Y, 40A/132Y/157G/262L/263A/603V/748Y, 40A/132Y/157G/262L/263A/537G/748Y, 40A/132Y/157G/262L/263A/589W/748Y, 40A/132Y/157G/262L/263A/598W/748Y, 22K/40A/132Y/157G/262L/263A/407R/748Y, 40A/132Y/157G/262L/263A/555W/748Y, 40A/132Y/157G/262L/263A/539R/748Y, 40A/132Y/157G/262L/263A/531Q/748Y, 40A/132Y/157G/262L/263A/581A/748Y, 40A/132Y/157G/262L/263A/748Y/803R, 40A/132Y/157G/262L/263A/538A/748Y, 40A/132Y/157G/262L/263A/404T/748Y, 40A/132Y/157G/262L/263A/406Q/748Y, 40A/132Y/157G/262L/263A/537L/748Y, 40A/132Y/157G/262L/263A/595R/748Y, 40A/132Y/157G/262L/263A/534W/748Y, 40A/132Y/157G/262L/263A/404S/748Y, 40A/132Y/157G/262L/263A/592V/748Y, 40A/132Y/157G/262L/263A/521W/748Y, 40A/132Y/157G/262L/263A/603G/748Y, 40A/132Y/157G/262L/263A/401I/748Y, 40A/132Y/157G/262L/263A/595A/748Y, 40A/132Y/157G/262L/263A/748Y/762Q, 40A/132Y/157G/262L/S263A/530W/748Y, 40A/132Y/157G/262L/263A/558V/748Y, 40A/132Y/157G/262L/263A/527W/748Y, 40A/132Y/157G/S263A/596W/748Y, 40A/132Y/157G/262L/263A/603W/748Y, 40A/132Y/157G/262L/263A/528W/748Y, 40A/132Y/157G/262L/263A/504M/748Y, 40A/132Y/157G/262L/263A/587Q/748Y, 40A/132Y/157G/262L/263A/523V/748Y, 40A/132Y/157G/262L/263A/521G/748Y, 40A/132Y/157G/262L/263A/558R/748Y, 40A/132Y/157G/262L/263A/593N/748Y, 40A/132Y/157G/262L/263A/525V/748Y, 40A/132Y/157G/262L/263A/748Y/749L, 40A/132Y/157G/262L/263A/503V/748Y, 40A/132Y/157G/262L/263A/527V/748Y, 40A/132Y/157G/262L/263A/554E/748Y, 40A/132Y/157G/262L/263A/535K/748Y, 40A/132Y/157G/262L/263A/592T/748Y, 40A/132Y/157G/262L/263A/528A/748Y, 40A/132Y/157G/262L/263A/585R/748Y, 40A/132Y/157G/262L/263A/401A/748Y, 40A/132Y/157G/262L/263A/586M/748Y, 40A/132Y/157G/262L/263A/748Y/764I, 40A/132Y/157G/262L/263A/556M/748Y, 40A/132Y/157G/262L/263A/748Y/763G, 40A/132Y/157G/262L/263A/406K/748Y, 40A/132Y/157G/262L/263A/582F/748Y, 40A/132Y/157G/262L/263A/540H/748Y, 40A/132Y/157G/262L/263A/560G/748Y, 40A/132Y/157G/262L/263A/402G/748Y, 40A/132Y/157G/262L/263A/594Q/748Y, 40A/132Y/157G/262L/263A/539L/748Y, 40A/132Y/157G/262L/263A/602V/748Y, 40A/132Y/157G/262L/263A/523A/748Y, 40A/132Y/157G/262L/263A/748Y/749T, 40A/132Y/157G/262L/263A/542T/748Y, 40A/132Y/157G/262L/263A/748Y/764A, 40A/132Y/157G/262L/263A/523K/748Y, 40A/132Y/157G/262L/263A/607N/748Y, 40A/132Y/157G/262L/263A/525L/748Y, 40A/132Y/157G/262L/263A/403L/748Y, 40A/132Y/157G/262L/263A/526T/748Y, 40A/132Y/157G/262L/263A/528R/748Y, 40A/132Y/157G/262L/263A/599G/748Y, 40A/132Y/157G/262L/263A/537W/748Y, 40A/132Y/157G/262L/263A/748Y/803C, 40A/132Y/157G/262L/263A/556F/748Y, 40A/132Y/157G/262L/263A/557G/748Y, 40A/132Y/157G/262L/263A/601M/748Y, 40A/132Y/157G/262L/263A/596R/748Y, 40A/132Y/157G/262L/263A/563L/748Y, 40A/132Y/157G/262L/263A/601P/748Y, 40A/132Y/157G/262L/263A/748Y/773R, 40A/132Y/157G/262L/263A/553R/748Y, 40A/132Y/157G/262L/263A/542M/748Y, 40A/132Y/157G/262L/263A/594T/748Y, 40A/132Y/157G/262L/263A/533L/748Y, 40A/132Y/157G/262L/263A/328I/748Y, 40A/132Y/157G/262L/263A/555K/748Y, 40A/132Y/157G/262L/263A/542G/748Y, or 40A/132Y/157G/262L/263A/528Q/748Y, 40A/132Y/157G/262L/263A/587S/748Y, 40A/132Y/157G/262L/263A/558Q/748Y, 40A/132Y/157G/262L/263A/403R/521A/748Y, 40A/132Y/157G/262L/263A/748Y/762M, 40A/132Y/157G/262L/263A/748Y/764V, or 40A/132Y/157G/262L/263A/403R/553K/748Y, wherein the amino acid positions are relative to the reference sequence of SEQ ID NO: 2.

In some embodiments the polypeptide sequence of the engineered DNA polymerase comprises at least a substitution or substitution set S40A/V132Y/S157G/I262L/S263A/N599S/H748Y, S40A/V132Y/S157G/I262L/S263A/K530G/H748Y, S40A/V132Y/S157G/I262L/S263A/S596L/H748Y, S40A/V132Y/S157G/I262L/S263A/R696H/H748Y, S40A/V132Y/S157G/I262L/S263A/R542W/H748Y, S40A/V132Y/S157G/I262L/S263A/K530R/H748Y, S40A/V132Y/S157G/I262L/S263A/Q553F/H748Y, S40A/V132Y/S157G/I262L/S263A/T533V/H748Y, S40A/V132Y/S157G/I262L/S263A/R555M/H748Y, S40A/V132Y/S157G/I262L/S263A/S594V/H748Y, S40A/V132Y/S157G/I262L/S263A/S594W/H748Y, S40A/V132Y/S157G/I262L/S263A/S536R/H748Y, S40A/V132Y/S157G/I262L/S263A/Q585K/H748Y, S40A/V132Y/S157G/I262L/S263A/S401G/H748Y, S40A/V132Y/S157G/I262L/S263A/D597E/H748Y, S40A/V132Y/S157G/I262L/S263A/Q553K/H748Y, S40A/V132Y/S157G/I262L/S263A/N402R/H748Y, S40A/V132Y/S157G/I262L/S263A/H748Y/A763Y, S40A/V132Y/S157G/I262L/S263A/H748Y/A762V, S40A/V132Y/S157G/I262L/S263A/I605E/H748Y, S40A/V132Y/S157G/I262L/S263A/K530P/H748Y, S40A/V132Y/S157G/I262L/S263A/R506P/H748Y, S40A/V132Y/S157G/I262L/S263A/A589G/H748Y, S40A/V132Y/S157G/I262L/S263A/A558S/H748Y, S40A/V132Y/S157G/I262L/S263A/Q553N/H748Y, S40A/V132Y/S157G/I262L/S263A/K559P/H748Y, S40A/V132Y/S157G/I262L/S263A/H748Y/E751H, S40A/V132Y/S157G/I262L/S263A/A589S/H748Y, S40A/V132Y/S157G/I262L/S263A/R747T/H748Y, S40A/V132Y/S157G/I262L/S263A/L560M/H748Y, S40A/V132Y/S157G/I262L/S263A/R696V/H748Y, S40A/V132Y/S157G/I262L/S263A/T540V/H748Y, S40A/V132Y/S157G/I262L/S263A/S594C/H748Y, S40A/V132Y/S157G/I262L/S263A/E556W/H748Y, S40A/V132Y/S157G/I262L/S263A/A589R/H748Y, S40A/V132Y/S157G/I262L/S263A/S407W/H748Y, S40A/V132Y/S157G/I262L/S263A/L557H/H748Y, S40A/V132Y/S157G/I262L/S263A/K559G/H748Y, S40A/V132Y/S157G/I262L/S263A/N599T/H748Y, S40A/V132Y/S157G/I262L/S263A/A521Y/H748Y, S40A/V132Y/S157G/I605A/I262L/S263A/H748Y, S40A/V132Y/S157G/I262L/S263A/K559D/H748Y, S40A/V132Y/S157G/I262L/S263A/S534H/H748Y, S40A/V132Y/S157G/I262L/S263A/R592G/H748Y, S40A/V132Y/S157G/I262L/S263A/T533P/H748Y, S40A/V132Y/S157G/I262L/S263A/G529S/H748Y, S40A/V132Y/S157G/I262L/S263A/R524G/H748Y, S40A/V132Y/S157G/I262L/S263A/H748Y/V749R, S40A/V132Y/S157G/I262L/S263A/H748Y/V766Y, S40A/V132Y/S157G/I262L/S263A/E556P/H748Y, S40A/V132Y/S157G/I262L/S263A/S595P/H748Y, S40A/V132Y/S157G/I262L/S263A/T533Q/

H748Y, S40A/V132Y/S157G/I262L/S263A/I603V/H748Y, S40A/V132Y/S157G/I262L/S263A/V537G/H748Y, S40A/V132Y/S157G/I262L/S263A/A589W/H748Y, S40A/V132Y/S157G/I262L/S263A/P598W/H748Y, S40A/V132Y/S157G/I262L/S263A/S407R/H748Y, S40A/V132Y/S157G/I262L/S263A/R555W/H748Y, S40A/V132Y/S157G/I262L/S263A/E539R/H748Y, S40A/V132Y/S157G/I262L/S263A/R531Q/H748Y, S40A/V132Y/S157G/I262L/S263A/T581A/H748Y, S40A/V132Y/S157G/I262L/S263A/H748Y/H803R, S40A/V132Y/S157G/I262L/S263A/L538A/H748Y, S40A/V132Y/S157G/I262L/S263A/Q404T/H748Y, S40A/V132Y/S157G/I262L/S263A/A406Q/H748Y, S40A/V132Y/S157G/I262L/S263A/V537L/H748Y, S40A/V132Y/S157G/I262L/S263A/S595R/H748Y, S40A/V132Y/S157G/I262L/S263A/S534W/H748Y, S40A/V132Y/S157G/I262L/S263A/Q404S/H748Y, S40A/V132Y/S157G/I262L/S263A/R592V/H748Y, S40A/V132Y/S157G/I262L/S263A/A521W/H748Y, S40A/V132Y/S157G/I262L/S263A/I603G/H748Y, S40A/V132Y/S157G/I262L/S263A/S401I/H748Y, S40A/V132Y/S157G/I262L/S263A/S595A/H748Y, S40A/V132Y/S157G/I262L/S263A/H748Y/A762Q, S40A/V132Y/S157G/I262L/S263A/K530W/H748Y, S40A/V132Y/S157G/I262L/S263A/A558V/H748Y, S40A/V132Y/S157G/I262L/S263A/K527W/H748Y, S40A/V132Y/S157G/I262L/S263A/S596W/H748Y, S40A/V132Y/S157G/I262L/S263A/I603W/H748Y, S40A/V132Y/S157G/I262L/S263A/T528W/H748Y, S40A/V132Y/S157G/I262L/S263A/N504M/H748Y, S40A/V132Y/S157G/I262L/S263A/G587Q/H748Y, S40A/V132Y/S157G/I262L/S263A/R523V/H748Y, S40A/V132Y/S157G/I262L/S263A/A521G/H748Y, S40A/V132Y/S157G/I262L/S263A/A558R/H748Y, S40A/V132Y/S157G/I262L/S263A/L593N/H748Y, S40A/V132Y/S157G/I262L/S263A/T525V/H748Y, S40A/V132Y/S157G/I262L/S263A/H748Y/V749L, S40A/V132Y/S157G/I262L/S263A/L503V/H748Y, S40A/V132Y/S157G/I262L/S263A/K527V/H748Y, S40A/V132Y/S157G/I262L/S263A/Y554E/H748Y, S40A/V132Y/S157G/I262L/S263A/A535K/H748Y, S40A/V132Y/S157G/I262L/S263A/R592T/H748Y, S40A/V132Y/S157G/I262L/S263A/T528A/H748Y, S40A/V132Y/S157G/I262L/S263A/Q585R/H748Y, S40A/V132Y/S157G/I262L/S263A/S401A/H748Y, S40A/V132Y/S157G/I262L/S263A/T586M/H748Y, S40A/V132Y/S157G/I262L/S263A/H748Y/E764I, S40A/V132Y/S157G/I262L/S263A/E556M/H748Y, S40A/V132Y/S157G/I262L/S263A/H748Y/A763G, S40A/V132Y/S157G/I262L/S263A/A406K/H748Y, S40A/V132Y/S157G/I262L/S263A/R582F/H748Y, S40A/V132Y/S157G/I262L/S263A/T540H/H748Y, S40A/V132Y/S157G/I262L/S263A/L560G/H748Y, S40A/V132Y/S157G/I262L/S263A/N402G/H748Y, S40A/V132Y/S157G/I262L/S263A/S594Q/H748Y, S40A/V132Y/S157G/I262L/S263A/E539L/H748Y, S40A/V132Y/S157G/I262L/S263A/N602V/H748Y, S40A/V132Y/S157G/I262L/S263A/R523A/H748Y, S40A/V132Y/S157G/I262L/S263A/H748Y/V749T, S40A/V132Y/S157G/I262L/S263A/R542T/H748Y, S40A/V132Y/S157G/I262L/S263A/H748Y/E764A, S40A/V132Y/S157G/I262L/S263A/R523K/H748Y, S40A/V132Y/S157G/I262L/S263A/T607N/H748Y, S40A/V132Y/S157G/I262L/S263A/T525L/H748Y, S40A/V132Y/S157G/I262L/S263A/N403L/H748Y, S40A/V132Y/S157G/I262L/S263A/A526T/H748Y, S40A/V132Y/S157G/I262L/S263A/T528R/H748Y, S40A/V132Y/S157G/I262L/S263A/N599G/H748Y, S40A/V132Y/S157G/I262L/S263A/V537W/H748Y, S40A/V132Y/S157G/I262L/S263A/H748Y/H803C, S40A/V132Y/S157G/I262L/S263A/E556F/H748Y, S40A/V132Y/S157G/I262L/S263A/L557G/H748Y, S40A/V132Y/S157G/I262L/S263A/Q601M/H748Y, S40A/V132Y/S157G/I262L/S263A/S596R/H748Y, S40A/V132Y/S157G/I262L/S263A/T563L/H748Y, S40A/V132Y/S157G/I262L/S263A/Q601P/H748Y, S40A/V132Y/S157G/I262L/S263A/H748Y/Q773R, S40A/V132Y/S157G/I262L/S263A/Q553R/H748Y, S40A/V132Y/S157G/I262L/S263A/R542M/H748Y, S40A/V132Y/S157G/I262L/S263A/S594T/H748Y, S40A/V132Y/S157G/I262L/S263A/T533L/H748Y, S40A/V132Y/S157G/I262L/S263A/V328I/H748Y, S40A/V132Y/S157G/I262L/S263A/R555K/H748Y, S40A/V132Y/S157G/I262L/S263A/R542G/H748Y, S40A/V132Y/S157G/I262L/S263A/T528Q/H748Y, S40A/V132Y/S157G/I262L/S263A/G587S/H748Y, S40A/V132Y/S157G/I262L/S263A/A558Q/H748Y, S40A/V132Y/S157G/I262L/S263A/N403R/G521A/H748Y, S40A/V132Y/S157G/I262L/S263A/H748Y/A762M, S40A/V132Y/S157G/I262L/S263A/H748Y/E764V, or S40A/V132Y/S157G/I262L/S263A/N403R/Q553K/H748Y, wherein the amino acid positions are relative to the reference sequence of SEQ ID NO: 2.

In some embodiments, the polypeptide sequence of the engineered DNA polymerase comprises at least a substitution set at amino acid position: 40/132/157/262/263/403/404/521/524/542/555/748/762/764, 40/132/157/262/263/404/521/524/542/589/748/762/764, 40/132/157/262/263/521/524/542/581/748/762/764, 40/132/157/262/263/521/542/748/762/764, 40/132/157/262/263/404/521/542/748/762, 40/132/157/262/263/521/748/750/849, 40/132/157/262/263/521/524/581/748, 16/40/132/157/262/263/521/735/748, 40/132/157/262/263/521/748/820, 40/132/157/262/263/521/748/793, 40/132/157/262/263/521/748/764, 40/132/157/262/263/521/748/755, 40/132/157/262/263/521/748/753, 40/132/157/262/263/521/735/748, 40/132/157/262/263/521/748/728, 40/132/157/262/263/521/704/748, 40/132/157/262/263/521/675/748, 40/132/157/262/263/521/671/748, 40/132/157/262/263/521/570/748, 40/132/157/262/263/495/521/748, 40/132/157/262/263/480/521/748, 40/132/157/262/263/476/521/748, 40/132/157/262/263/384/521/748, 40/132/157/262/263/322/521/748, 40/132/157/262/263/321/521/748, 40/132/157/243/262/263/521/748, 15/40/132/157/262/263/521/748, 40/102/132/157/262/263/521/748, 40/91/132/157/262/263/521/748, 40/87/132/157/262/263/521/748, 40/85/132/157/262/263/521/748, 20/40/132/157/262/263/521/748, 21/40/132/157/262/263/521/748, or 40/52/132/157/262/263/521/748, wherein the amino acid positions are relative to the reference sequence of SEQ ID NO: 2.

In some embodiments, the polypeptide sequence of the engineered DNA polymerase comprises at least a substitution set 40A/132Y/157G/262L/263A/404S/521G/542G/748Y/762M, 40A/132Y/157G/262L/263A/521G/524Q/542G/581A/748Y/762M/764V, 40A/132Y/157G/262L/263A/404S/521G/524Q/542G/589L/748Y/762M/764V, 40A/132Y/157G/262L/263A/521G/748Y/764V, 40A/132Y/157G/262L/263A/403R/404S/521G/524Q/542G/555H/748Y/762M/764V, 40A/132Y/157G/262L/263A/476N/521G/748Y, 40A/132Y/157G/262L/263A/521G/542G/748Y/762M/764V, 40A/132Y/157G/262L/263A/521G/748Y/728K, 40A/52R/132Y/157G/262L/263A/521G/748Y, 40A/132Y/157G/262L/263A/476I/521G/748Y, 40A/132Y/157G/262L/263A/521G/675L/748Y, 40A/132Y/157G/262L/263A/521G/748Y/750S/849T, 40A/102S/132Y/

157G/262L/263A/521G/748Y, 21C/40A/132Y/157G/262L/ 263A/521G/748Y, 40A/132Y/157G/262L/263A/521G/ 748Y/755P, 21S/40A/132Y/157G/262L/263A/521G/748Y, 40A/132Y/157G/262L/263A/321G/521G/748Y, 20A/40A/ 132Y/157G/262L/263A/521G/748Y, 21K/40A/132Y/157G/ 262L/263A/521G/748Y, 40A/87N/132Y/157G/262L/263A/ 521G/748Y, 20C/40A/132Y/157G/262L/263A/521G/748Y, 16R/40A/132Y/157G/262L/263A/521G/735L/748Y, 21Q/ 40A/132Y/157G/262L/263A/521G/748Y, 40A/132Y/157G/ 262L/263A/521G/704P/748Y, 40A/132Y/157G/262L/ 263A/521G/735G/748Y, 40A/132Y/157G/262L/263A/ 384Y/521G/748Y, 40A/132Y/157G/262L/263A/480W/ 521G/748Y, 40A/V102M/132Y/157G/262L/263A/521G/ 748Y, 40A/132Y/157G/262L/263A/521G/748Y/793G, 40A/132Y/157G/262L/263A/322S/521G/748Y, 40A/132Y/ 157G/262L/263A/322N/521G/748Y, 40A/132Y/157G/ 262L/263A/521G/570R/748Y, 40A/132Y/157G/262L/ 263A/480V/521G/748Y, 40A/132Y/157G/262L/263A/ 521G/748Y/753V, 40A/132Y/157G/262L/263A/521G/ 748Y/753K, 40A/132Y/157G/262L/263A/521G/R524Q/ 581A/748Y, 40A/91K/132Y/157G/262L/263A/521G/748Y, 40A/132Y/157G/243L/262L/263A/521G/748Y, 40A/132Y/ 157G/243S/262L/263A/521G/748Y, 40A/132Y/157G/ 262L/263A/521G/671E/748Y, 40A/85S/132Y/157G/262L/ 263A/521G/748Y, 40A/132Y/157G/262L/263A/495M/ 521G/748Y, 15A/40A/132Y/157G/262L/263A/521G/748Y, 15N/40A/132Y/157G/262L/263A/521G/748Y, 15K/40A/ 132Y/157G/262L/263A/521G/748Y, 40A/132Y/157G/ 262L/263A/521G/748Y/820A, 40A/132Y/157G/262L/ 263A/495E/521G/748Y/, 40A/85E/132Y/157G/262L/ 263A/521G/748Y, 40A/85R/132Y/157G/262L/263A/521G/ 748Y, 40A/132Y/157G/262L/263A/480E/521G/748Y, 15G/ 40A/132Y/157G/262L/263A/521G/748Y, or 40A/132Y/ 157G/262L/263A/521G/671R/748Y, wherein the amino acid positions are relative to the reference sequence of SEQ ID NO: 2.

In some embodiments, the polypeptide sequence of the engineered DNA polymerase comprises at least a substitution set S40A/V132Y/S157G/I262L/S263A/Q404S/A521G/ R542G/H748Y/A762M, S40A/V132Y/S157G/I262L/ S263A/A521G/R524Q/R542G/T581A/H748Y/A762M/ E764V, S40A/V132Y/S157G/I262L/S263A/Q404S/ A521G/R524Q/R542G/A589L/H748Y/A762M/E764V, S40A/V132Y/S157G/I262L/S263A/A521G/H748Y/ E764V, S40A/V132Y/S157G/I262L/S263A/N403R/Q404S/ A521G/R524Q/R542G/R555H/H748Y/A762M/E 764V, S40A/V132Y/S157G/I262L/S263A/L476N/A521G/ H748Y, S40A/V132Y/S157G/I262L/S263A/A521G/ R542G/H748Y/A762M/E764V, S40A/V132Y/S157G/ I262L/S263A/A521G/H748Y/R728K, S40A/S52R/V132Y/ S157G/I262L/S263A/A521G/H748Y, S40A/V132Y/ S157G/I262L/S263A/L476I/A521G/H748Y, S40A/V132Y/ S157G/I262L/S263A/A521G/P675L/H748Y, S40A/ V132Y/S157G/I262L/S263A/A521G/H748Y/P750S/ A849T, S40A/V102S/V132Y/S157G/I262L/S263A/ A521G/H748Y, F21C/S40A/V132Y/S157G/I262L/S263A/ A521G/H748Y, S40A/V132Y/S157G/I262L/S263A/ A521G/H748Y/K755P, F21S/S40A/V132Y/S157G/I262L/ S263A/A521G/H748Y, S40A/V132Y/S157G/I262L/ S263A/E321G/A521G/H748Y, L20A/S40A/V132Y/ S157G/I262L/S263A/A521G/H748Y, F21K/S40A/V132Y/ S157G/I262L/S263A/A521G/H748Y, S40A/P87N/V132Y/ S157G/I262L/S263A/A521G/H748Y, L20C/S40A/V132Y/ S157G/I262L/S263A/A521G/H748Y, Q16R/S40A/V132Y/ S157G/I262L/S263A/A521G/E735L/H748Y, F21Q/S40A/ V132Y/S157G/I262L/S263A/A521G/H748Y, S40A/ V132Y/S157G/I262L/S263A/A521G/D704P/H748Y, S40A/V132Y/S157G/I262L/S263A/A521G/E735G/ H748Y, S40A/V132Y/S157G/I262L/S263A/R384Y/ A521G/H748Y, S40A/V132Y/S157G/I262L/S263A/ Q480W/A521G/H748Y, S40A/V102M/V132Y/S157G/ I262L/S263A/A521G/H748Y, S40A/V132Y/S157G/I262L/ S263A/A521G/H748Y/P793G, S40A/V132Y/S157G/ I262L/S263A/R322S/A521G/H748Y, S40A/V132Y/ S157G/I262L/S263A/R322N/A521G/H748Y, S40A/ V132Y/S157G/I262L/S263A/A521G/K570R/H748Y, S40A/V132Y/S157G/I262L/S263A/Q480V/A521G/ H748Y, S40A/V132Y/S157G/I262L/S263A/A521G/ H748Y/L753V, S40A/V132Y/S157G/I262L/S263A/ A521G/H748Y/L753K, S40A/V132Y/S157G/I262L/ S263A/A521G/R524Q/T581A/H748Y, S40A/H91K/ V132Y/S157G/I262L/S263A/A521G/H748Y, S40A/ V132Y/S157G/P243L/I262L/S263A/A521G/H748Y, S40A/V132Y/S157G/P243S/I262L/S263A/A521G/H748Y, S40A/V132Y/S157G/I262L/S263A/A521G/V671E/ H748Y, S40A/P85S/V132Y/S157G/I262L/S263A/A521G/ H748Y, S40A/V132Y/S157G/I262L/S263A/R495M/ A521G/H748Y, V15A/S40A/V132Y/S157G/I262L/S263A/ A521G/H748Y, V15N/S40A/V132Y/S157G/I262L/S263A/ A521G/H748Y, V15K/S40A/V132Y/S157G/I262L/S263A/ A521G/H748Y, S40A/V132Y/S157G/I262L/S263A/ A521G/H748Y/R820A, S40A/V132Y/S157G/I262L/ S263A/A521G/H748Y/R495E, S40A/P85E/V132Y/ S157G/I262L/S263A/A521G/H748Y, S40A/P85R/V132Y/ S157G/I262L/S263A/A521G/H748Y, S40A/V132Y/ S157G/I262L/S263A/Q480E/A521G/H748Y, V15G/S40A/ V132Y/S157G/I262L/S263A/A521G/H748Y, S40A/ V132Y/S157G/I262L/S263A/A521G/V671R/H748Y, wherein the amino acid positions are relative to the reference sequence of SEQ ID NO: 2.

In some embodiments, the polypeptide sequence of the engineered DNA polymerase comprises at least a substitution set at amino acid position 40/102/132/157/262/263/476/ 521/748, 40/102/132/157/262/263/495/521/748, 40/102/ 132/157/262/263/521/748/750, 21/40/52/102/132/157/262/ 263/521/748, 21/40/102/132/157/262/263/322/521/748, 20/40/102/132/157/262/263/322/521/748, 20/40/102/132/ 157/262/263/476/521/748, 40/85/102/132/157/262/263/ 521/748/750, 40/102/132/157/262/263/386/495/521/748, 40/102/132/157/262/263/476/495/521/748, 40/102/132/ 157/262/263/322/521/748/820, 40/102/132/157/262/263/ 386/521/748/849, 20/40/52/85/102/132/157/262/263/521/ 748, 40/102/132/157/262/263/476/521/748/750, 40/102/ 132/157/262/263/495/521/748/820, 40/102/132/157/262/ 263/521/748/750/820, 21/40/52/102/132/157/262/263/521/ 572/748, 20/40/102/132/157/262/263/322/386/521/748, 21/40/102/132/157/262/263/322/495/521/748, 40/85/102/ 132/157/262/263/322/476/521/748, 20/40/102/132/157/ 262/263/386/476/521/748, 21/40/102/132/157/262/263/ 322/521/748/750, 21/40/102/132/157/262/263/495/521/ 748/820, 20/40/102/132/157/262/263/495/521/748/820, 40/85/102/132/157/262/263/476/521/748/849, 21/40/102/ 132/157/262/263/521/748/820/849, 40/102/132/157/262/ 263/322/386/495/521/748, 40/102/132/157/262/263/273/ 322/521/748/849, 40/102/132/157/262/263/476/495/521/ 748/750, 40/102/132/157/262/263/322/521/748/750/820, 40/102/132/157/262/263/386/521/748/750/849, 21/40/85/ 102/132/157/262/263/322/521/748/820, 20/40/85/102/132/ 157/262/263/476/521/748/750, 20/40/85/102/132/157/262/ 263/495/521/748/849, 20/40/85/102/132/157/262/263/521/ 566/748/820, 40/52/102/132/157/262/263/322/498/521/ 748/750, 21/40/102/132/157/262/263/322/386/521/748/ 820, 40/52/102/132/157/262/263/386/495/521/748/820, 20/40/102/132/157/262/263/322/476/521/748/820, 40/85/

102/132/157/262/263/386/495/521/748/750, 40/85/102/132/157/262/263/322/521/748/750/820, 40/85/102/132/157/262/263/322/521/748/750/820, 40/85/102/132/157/262/263/322/386/476/495/521/748, 21/40/102/132/157/262/263/322/495/521/748/750/820, 20/21/40/85/102/132/157/262/263/322/476/495/521/748, 20/40/102/132/157/262/263/299/322/386/476/495/521/748, 40/52/102/132/157/262/263/476/495/521/566/748/750/849, 20/40/85/102/132/157/262/200/263/322/476/495/521/748/750, or 21/40/85/102/132/157/262/263/322/386/495/521/748/820/849, wherein the amino acid positions are relative to the reference sequence of SEQ ID NO: 2.

In some embodiments, the polypeptide sequence of the engineered DNA polymerase comprises at least a substitution set 40A/102S/132Y/157G/262L/263A/521G/748Y/750S/820A, 21C/40A/52R/102S/132Y/157G/262L/263A/521G/748Y, 20C/21C/40A/85E/102S/132Y/157G/262L/263A/322N/476N/495E/521G/748Y, 20C/40A/85E/102S/132Y/157G/262L/200V/263A/322N/476N/495S/521G/748Y/750S, 40A/102S/132Y/157G/262L/263A/476N/521G/748Y/750S, 20C/40A/102S/132Y/157G/262L/263A/476N/521G/748Y, 20C/40A/102S/132Y/157G/262L/263A/322N/386V/521G/748Y, 40A/85E/102S/132Y/157G/262L/263A/322N/476N/521G/748Y, 40A/52R/102S/132Y/157G/262L/263A/322N/498D/521G/748Y/750S, 20C/40A/102S/132Y/157G/262L/263A/322N/476N/521G/748Y/820A, 40A/85E/102S/132Y/157G/262L/263A/476N/495E/521G/748Y/820A, 21C/40A/85E/102S/132Y/157G/262L/263A/322N/521G/748Y/820A, 20C/40A/102S/132Y/157G/262L/263A/299N/322N/386V/476N/495E/521G/748Y, 20C/40A/102S/132Y/157G/262L/263A/322N/521G/748Y, 21C/40A/102S/132Y/157G/262L/263A/521G/748Y/820A/849T, 40A/102S/132Y/157G/262L/263A/476N/521G/748Y, 40A/102S/132Y/157G/262L/263A/322N/521G/748Y/820A, 21C/40A/102S/132Y/157G/262L/263A/322N/386V/521G/748Y/820A, 40A/102S/132Y/157G/262L/263A/322N/386V/495E/521G/748Y, 40A/85E/102S/132Y/157G/262L/263A/386V/495E/521G/748Y/750S, 20C/40A/85E/102S/132Y/157G/262L/263A/476N/521G/748Y/750S, 20C/40A/102S/132Y/157G/262L/263A/386V/476N/521G/748Y, 40A/85E/102S/132Y/157G/262L/263A/322N/386V/476N/495S/521G/748Y, 20C/40A/102S/132Y/157G/262L/263A/495E/521G/748Y/820A, 40A/102S/132Y/157G/262L/263A/521G/748Y/750S, 21C/40A/102S/132Y/157G/262L/263A/322N/495E/521G/748Y, 40A/52R/102S/132Y/157G/262L/263A/386V/495S/521G/748Y/820A, 21C/40A/102S/132Y/157G/262L/263A/322N/521G/748Y, 40A/85E/102S/132Y/157G/262L/263A/322N/521G/748Y/750S/820A, 20C/40A/52R/85E/102S/132Y/157G/262L/263A/521G/748Y, 21C/40A/52R/102S/132Y/157G/262L/263A/521G/572I/748Y, 20C/40A/85E/102S/132Y/157G/262L/263A/495E/521G/748Y/849T, 40A/85E/102S/132Y/157G/262L/263A/521G/748Y/750S, 21C/40A/102S/132Y/157G/262L/263A/495E/521G/748Y/820A, 40A/102S/132Y/157G/262L/263A/273M/322N/521G/748Y/849T, 40A/102S/132Y/157G/262L/263A/495E/521G/748Y, 40A/102S/132Y/157G/262L/263A/322N/521G/748Y/750S/820A, 40A/52R/102S/132Y/157G/262L/263A/476N/495E/521G/566A/748Y/750S/849T, 40A/102S/132Y/157G/262L/263A/386V/495E/521G/748Y, 40A/102S/132Y/157G/262L/263A/495S/521G/748Y/820A, 21C/40A/102S/132Y/157G/262L/263A/322N/495E/521G/748Y/750S/820A, 21C/40A/85E/102S/132Y/157G/262L/263A/322N/386V/495S/521G/748Y/820A/849T, 40A/102S/132Y/157G/262L/263A/495S/521G/748Y, 40A/102S/132Y/157G/262L/263A/476N/495E/521G/748Y/750S, 40A/102S/132Y/157G/262L/263A/386V/521G/748Y/849T, 40A/102S/132Y/157G/262L/263A/476N/495E/521G/748Y, 40A/85E/102S/132Y/157G/262L/263A/476N/521G/748Y/849T, 21C/40A/102S/132Y/157G/262L/263A/322N/521G/748Y/750S, 20C/40A/85E/102S/132Y/157G/262L/263A/521G/566A/748Y/820A, or 40A/102S/132Y/157G/262L/263A/386V/521G/748Y/750S/849T, wherein the amino acid positions are relative to the reference sequence of SEQ ID NO: 2.

In some embodiments, the polypeptide sequence of the engineered DNA polymerase comprises at least a substitution set: S40A/V102S/V132Y/S157G/I262L/S263A/A521G/H748Y/P750S/R820A, F21C/S40A/S52R/V102S/V132Y/S157G/I262L/S263A/A521G/H748Y, L20C/F21C/S40A/P85E/V102S/V132Y/S157G/I262L/S263A/R322N/L476N/R495E/A521G/H748Y, L20C/S40A/P85E/V102S/V132Y/S157G/I262L/A200V/S263A/R322N/L476N/R495S/A521G/H748Y/P750S, S40A/V102S/V132Y/S157G/I262L/S263A/L476N/A521G/H748Y/P750S, L20C/S40A/V102S/V132Y/S157G/I262L/S263A/L476N/A521G/H748Y, L20C/S40A/V102S/V132Y/S157G/I262L/S263A/R322N/R386V/A521G/H748Y, S40A/P85E/V102S/V132Y/S157G/I262L/S263A/R322N/L476N/A521G/H748Y, S40A/S52R/V102S/V132Y/S157G/I262L/S263A/R322N/G498D/A521G/H748Y/P750S, L20C/S40A/V102S/V132Y/S157G/I262L/S263A/R322N/L476N/A521G/H748Y/R820A, S40A/P85E/V102S/V132Y/S157G/I262L/S263A/L476N/R495E/A521G/H748Y/R820A, F21C/S40A/P85E/V102S/V132Y/S157G/I262L/S263A/R322N/A521G/H748Y/R820A, L20C/S40A/V102S/V132Y/S157G/I262L/S263A/T299N/R322N/R386V/L476N/R495E/A521G/H748Y, L20C/S40A/V102S/V132Y/S157G/I262L/S263A/R322N/A521G/H748Y, F21C/S40A/V102S/V132Y/S157G/I262L/S263A/A521G/H748Y/R820A/A849T, S40A/V102S/V132Y/S157G/I262L/S263A/L476N/A521G/H748Y, S40A/V102S/V132Y/S157G/I262L/S263A/R322N/A521G/H748Y/R820A, F21C/S40A/V102S/V132Y/S157G/I262L/S263A/R322N/R386V/A521G/H748Y/R820A, S40A/V102S/V132Y/S157G/I262L/S263A/R322N/R386V/R495E/A521G/H748Y, S40A/P85E/V102S/V132Y/S157G/I262L/S263A/R386V/R495E/A521G/H748Y/P750S, L20C/S40A/P85E/V102S/V132Y/S157G/I262L/S263A/L476N/A521G/H748Y/P750S, L20C/S40A/V102S/V132Y/S157G/I262L/S263A/R386V/L476N/A521G/H748Y, S40A/P85E/V102S/V132Y/S157G/I262L/S263A/R322N/R386V/L476N/R495S/A521G/H748Y, L20C/S40A/V102S/V132Y/S157G/I262L/S263A/R495E/A521G/H748Y/R820A, S40A/V102S/V132Y/S157G/I262L/S263A/A521G/H748Y/P750S, F21C/S40A/V102S/V132Y/S157G/I262L/S263A/R322N/R495E/A521G/H748Y, S40A/S52R/V102S/V132Y/S157G/I262L/S263A/R386V/R495S/A521G/H748Y/R820A, F21C/S40A/V102S/V132Y/S157G/I262L/S263A/R322N/A521G/H748Y, S40A/P85E/V102S/V132Y/S157G/I262L/S263A/R322N/A521G/H748Y/P750S/R820A, L20C/S40A/S52R/P85E/V102S/V132Y/S157G/I262L/S263A/A521G/H748Y, F21C/S40A/S52R/V102S/V132Y/S157G/I262L/S263A/A521G/V572I/H748Y, L20C/S40A/P85E/V102S/V132Y/S157G/I262L/S263A/R495E/A521G/H748Y/A849T, S40A/P85E/V102S/V132Y/S157G/I262L/S263A/A521G/H748Y/P750S, F21C/S40A/V102S/V132Y/S157G/I262L/S263A/R495E/A521G/H748Y/R820A, S40A/V102S/V132Y/S157G/I262L/S263A/V273M/R322N/A521G/H748Y/A849T, S40A/V102S/V132Y/S157G/I262L/S263A/R495E/A521G/H748Y, S40A/V102S/V132Y/S157G/I262L/S263A/R322N/A521G/H748Y/P750S/R820A, S40A/S52R/V102S/V132Y/S157G/I262L/S263A/L476N/R495E/A521G/

D566A/H748Y/P750S/A849T, S40A/V102S/V132Y/S157G/I262L/S263A/R386V/R495E/A521G/H748Y, S40A/V102S/V132Y/S157G/I262L/S263A/R495S/A521G/H748Y/R820A, F21C/S40A/V102S/V132Y/S157G/I262L/S263A/R322N/R495E/A521G/H748Y/P750S/R820A, F21C/S40A/P85E/V102S/V132Y/S157G/I262L/S263A/R322N/R386V/R495S/A521G/H748Y/R820 A/A849T, S40A/V102S/V132Y/S157G/I262L/S263A/R495S/A521G/H748Y, S40A/V102S/V132Y/S157G/I262L/S263A/L476N/R495E/A521G/H748Y/P750S, S40A/V102S/V132Y/S157G/I262L/S263A/R386V/A521G/H748Y/A849T, S40A/V102S/V132Y/S157G/I262L/S263A/L476N/R495E/A521G/H748Y, S40A/P85E/V102S/V132Y/S157G/I262L/S263A/L476N/A521G/H748Y/A849T, F21C/S40A/V102S/V132Y/S157G/I262L/S263A/R322N/A521G/H748Y/P750S, L20C/S40A/P85E/V102S/V132Y/S157G/I262L/S263A/A521G/D566A/H748Y/R820A, S40A/V102S/V132Y/S157G/I262L/S263A/R386V/A521G/H748Y/P750S/A849T, wherein the amino acid positions are relative to the reference sequence of SEQ ID NO: 2.

In some embodiments, the polypeptide sequence of the engineered DNA polymerase comprises at least a substitution or substitution set at amino acid position: 40/85/102/132/157/262/263/299/386/521/566/748/750/820, 40/85/102/132/157/262/263/476/521/748/750/820/849, 21/40/85/102/132/157/262/263/322/476/495/521/748/750/820, 40/85/102/132/157/262/177/263/521/748/750, 21/40/85/102/132/157/262/263/495/521/748/750, 40/85/102/132/157/262/263/476/521/748/750/820, 20/40/52/85/102/132/157/262/263/299/521/748/750, 52/40/85/102/132/157/262/263/299/521/748/750, 40/85/102/132/157/262/263/322/521/748Y/750S/820, 20/40/85/102/132/157/262/263/521/748/750/820, 20/40/85/102/132/157/262/263/299/386/476/521/748/750, 40/85/102/132/157/262/263/386/476/521/748/750/820, 40/85/102/132/157/262/263/476/495/521/748/750/820, 40/85/102/132/157/262/263/386/476/495/521/748/750, 20/21/40/85/102/132/157/262/263/299/322/386/521/748/750, 40/85/102/132/157/262/263/322/386/495/521/748/750, 21/40/85/102/132/157/262/263/299/322/476/495/521/748/750/820, 21/40/85/102/132/157/262/263/299/386/521/748/750/820, 40/85/102/132/157/262/263/299/476/521/748/750/820, 20/21/40/85/102/132/157/262/263/521/748/750, 21/40/102/132/157/262/263/521/748/750, 40/85/102/132/157/262/263/521/705/748/750, 21/40/85/102/132/157/262/263/386/476/521/748/750/820, 40/85/102/132/157/262/263/521/748/750/820, 21/40/85/102/132/157/262/263/299/322/521/748/750, 20/40/85/102/132/157/262/263/322/386/521/748/750/820, 40/85/102/132/157/262/263/299/521/748/750, 21/40/85/102/132/157/262/263/299/386/476/521/748/750, 40/85/102/109/132/157/262/263/521/748/750, 40/85/102/132/157/262/263/322/495/521/748/750, 40/85/102/132/157/262/263/491/521/748/750, 40/52/85/102/132/157/262/263/521/748/750/820, 21/40/85/102/132/157/262/263/386/521/748/750/820, 20/21/40/85/102/132/157/262/263/495/521/748/750, 21/40/85/102/132/157/262/263/299/322/495/521/566/748/750/820, 20/21/40/85/102/132/157/262/263/299/495/521/748/750, 40/85/102/132/157/262/263/521/748/750/756, 40/85/102/132/157/262/263/386/521/748/750/820, 40/85/102/132/157/262/263/495/521/748/750, 40/85/102/132/157/262/263/511/521/748/750, 21/40/52/85/102/132/157/262/263/242/386/495/521/748/750/820, 40/85/102/132/157/262/263/299/476/495/521/748/750, 40/85/102/132/157/262/263/521/706/748/750, 21/40/85/102/132/157/262/263/299/386/476/495/521/748/750, 21/40/85/102/132/157/262/263/299/322/495/521/748/750, 21/40/85/102/132/157/262/263/476/521/748/750/849, 40/85/102/132/157/262/263/299/322/476/521/748/750/820, 21/40/52/85/102/132/157/262/263/299/322/521/748/750/820, 20/21/40/85/102/132/157/262/263/521/566/748/750, 20/40/52/85/102/132/157/262/263/521/566/748/750, 40/85/102/132/157/262/263/521/748/750, 40/85/102/132/157/262/263/322/386/495/521/566/748/750/820, 21/40/85/102/132/157/262/263/299/521/748/750, 21/40/85/102/132/157/262/263/299/386/521/748/750, 40/85/102/132/157/262/263/386/521/748/750/849, 40/52/85/102/132/157/262/263/476/521/748/750, 40/52/85/102/132/157/262/263/299/322/386/495/521/748/750, or 40/85/102/132/157/262/263/440/521/748/750, wherein the amino acid positions are relative to the reference sequence of SEQ ID NO: 2.

In some embodiments, the polypeptide sequence of the engineered DNA polymerase comprises at least a substitution or substitution set 40A/85E/102S/132Y/157G/262L/263A/299N/386V/521G/566A/748Y/750S/820A, 40A/85E/102S/132Y/157G/262L/263A/476N/521G/748Y/750S/820A/849T, 21C/40A/85E/102S/132Y/157G/262L/263A/322N/476N/495E/521G/748Y/750S/820A, 40A/85E/102S/132Y/157G/262L/177T/263A/521G/748Y/750S, 21C/40A/85E/102S/132Y/157G/262L/263A/495E/521G/748Y/750S, 40A/85E/102S/132Y/157G/262L/263A/476N/521G/748Y/750S/820A, 20C/40A/52R/85E/102S/132Y/157G/262L/263A/299N/521G/748Y/750S, 52R/40A/85E/102S/132Y/157G/262L/263A/299N/521G/748Y/750S, 40A/85E/102S/132Y/157G/262L/263A/322N/521G/748Y/750S/820A, 20C/40A/85E/102S/132Y/157G/262L/263A/521G/748Y/750S/820A, 20C/40A/85E/102S/132Y/157G/262L/263A/299N/386V/476N/521G/748Y/750S, 40A/85E/102S/132Y/157G/262L/263A/386V/476N/521G/748Y/750S/820A, 40A/85E/102S/132Y/157G/262L/263A/476N/495E/521G/748Y/750S/820A, 40A/85E/102S/132Y/157G/262L/263A/386V/476N/495E/521G/748Y/750S, 20C/21C/40A/85E/102S/132Y/157G/262L/263A/299N/322N/386V/521G/748Y/750S, 40A/85E/102S/132Y/157G/262L/263A/322N/386V/495E/521G/748Y/750S, 21C/40A/85E/102S/132Y/157G/262L/263A/299N/322N/476N/495E/521G/748Y/750S/820A, 21C/40A/85E/102S/132Y/157G/262L/263A/299N/386V/521G/748Y/750S/820A, 40A/85E/102S/132Y/157G/262L/263A/299N/476N/521G/748Y/750S/820A, 20C/21C/40A/85E/102S/132Y/157G/262L/263A/521G/748Y/750S, 21C/40A/102S/132Y/157G/262L/263A/521G/748Y, 40A/85E/102S/132Y/157G/262L/263A/521G/705W/748Y/750S, 21C/40A/85E/102S/132Y/157G/262L/263A/386V/476N/521G/748Y/750S/820A, 40A/85E/102S/132Y/157G/262L/263A/521G/748Y/750S/820A, 21C/40A/85E/102S/132Y/157G/262L/263A/299N/322N/521G/748Y/750S, 20C/40A/85E/102S/132Y/157G/262L/263A/322N/386V/521G/748Y/750S/820A, 40A/85E/102S/132Y/157G/262L/263A/299N/521G/748Y/750S, 21C/40A/85E/102S/132Y/157G/262L/263A/299N/386V/476N/521G/748Y/750S, 40A/85E/102S/109P/132Y/157G/262L/263A/521G/748Y/750S, 40A/85E/102S/132Y/157G/262L/263A/322N/495E/521G/748Y/750S, 40A/85E/102S/132Y/157G/262L/263A/491G/521G/748Y/750S, 40A/52R/85E/102S/132Y/157G/262L/263A/521G/748Y/750S/820A, 21C/40A/85E/102S/132Y/157G/262L/263A/386V/521G/748Y/750S/820A, 20C/21C/40A/85E/102S/132Y/157G/262L/263A/495E/521G/748Y/750S, 21C/40A/85E/102S/132Y/157G/262L/263A/299N/322N/495E/521G/566A/748Y/750S/820A, 20C/21C/40A/85E/102S/132Y/157G/262L/263A/299N/495E/521G/748Y/750S, 40A/85E/102S/132Y/157G/262L/263A/521G/748Y/750S/756T, 40A/85E/102S/132Y/157G/262L/263A/386V/521G/748Y/750S/820A, 40A/85E/102S/132Y/157G/262L/263A/495E/521G/748Y/750S, 40A/85E/102S/132Y/157G/262L/263A/511M/521G/748Y/750S, 21C/40A/52R/85E/102S/132Y/157G/262L/263A/

242Q/386V/495E/521G/748Y/750S/820A, 40A/85E/102S/ 132Y/157G/262L/263A/299N/476N/495E/521G/748Y/ 750S, 40A/85E/102S/132Y/157G/262L/263A/521G/706E/ 748Y/750S, 21C/40A/85E/102S/132Y/157G/262L/263A/ 299N/386V/476N/495E/521G/748Y/750S, 21C/40A/85E/ 102S/132Y/157G/262L/263A/299N/322N/495E/521G/ 748Y/750S, 21C/40A/85E/102S/132Y/157G/262L/263A/ 476N/521G/748Y/750S/849T, 40A/85E/102S/132Y/157G/ 262L/263A/299N/322N/476N/521G/748Y/750S/820A, 21C/40A/52R/85E/102S/132Y/157G/262L/263A/299N/ 322N/521G/748Y/750S/820A, 20C/21C/40A/85E/102S/ 132Y/157G/262L/263A/521G/566A/748Y/750S, 20C/40A/ 52R/85E/102S/132Y/157G/262L/263A/521G/748Y/750S, 40A/85E/102S/132Y/157G/262L/263A/322N/386V/495E/ 521G/566A/748Y/750S/820A, 21C/40A/85E/102S/132Y/ 157G/262L/263A/299N/521G/748Y/750S, 21C/40A/85E/ 102S/132Y/157G/262L/263A/299N/386V/521G/748Y/ 750S, 40A/85E/102S/132Y/157G/262L/263A/386V/521G/ 748Y/750S/849T, 40A/52R/85E/102S/132Y/157G/262L/ 263A/476N/521G/748Y/750S, 40A/52R/85E/102S/132Y/ 157G/262L/263A/299N/322N/386V/495E/521G/748Y/ 750S, or 40A/85E/102S/132Y/157G/262L/263A/440G/ 521G/748Y/750S, wherein the amino acid positions are relative to the reference sequence of SEQ ID NO: 2.

In some embodiments, the polypeptide sequence of the engineered DNA polymerase comprises at least a substitution or substitution set S40A/P85E/V102S/V132Y/S157G/ I262L/S263A/T299N/R386V/A521G/D566A/H748Y/ P750S/R82 OA, S40A/P85E/V102S/V132Y/S157G/I262L/ S263A/L476N/A521G/H748Y/P750S/R820A/A849T, F21C/S40A/P85E/V102S/V132Y/S157G/I262L/S263A/ R322N/L476N/R495E/A521G/H748Y/P750S/R820A, S40A/P85E/V102S/V132Y/S157G/I262L/R177T/S263A/ A521G/H748Y/P750S, F21C/S40A/P85E/V102S/V132Y/ S157G/I262L/S263A/R495E/A521G/H748Y/P750S, S40A/ P85E/V102S/V132Y/S157G/I262L/S263A/L476N/A521G/ H748Y/P750S/R820A, L20C/S40A/S52R/P85E/V102S/ V132Y/S157G/I262L/S263A/T299N/A521G/H748Y/ P750S, S52R/S40A/P85E/V102S/V132Y/S157G/I262L/ S263A/T299N/A521G/H748Y/P750S, S40A/P85E/V102S/ V132Y/S157G/I262L/S263A/R322N/A521G/H748Y/ P750S/R820A, L20C/S40A/P85E/V102S/V132Y/S157G/ I262L/S263A/A521G/H748Y/P750S/R820A, L20C/S40A/ P85E/V102S/V132Y/S157G/I262L/S263A/T299N/R386V/ L476N/A521G/H748Y/P750S, S40A/P85E/V102S/V132Y/ S157G/I262L/S263A/R386V/L476N/A521G/H748Y/ P750S/R820A, S40A/P85E/V102S/V132Y/S157G/I262L/ S263A/L476N/R495E/A521G/H748Y/P750S/R820A, S40A/P85E/V102S/V132Y/S157G/I262L/S263A/R386V/ L476N/R495E/A521G/H748Y/P750S, L20C/F21C/S40A/ P85E/V102S/V132Y/S157G/I262L/S263A/T299N/R322N/ R386V/A521G/H748Y/P750S, S40A/P85E/V102S/V132Y/ S157G/I262L/S263A/R322N/R386V/R495E/A521G/ H748Y/P750S, F21C/S40A/P85E/V102S/V132Y/S157G/ I262L/S263A/T299N/R322N/L476N/R495E/A521G/H748 Y/P750S/R820A, F21C/S40A/P85E/V102S/V132Y/ S157G/I262L/S263A/T299N/R386V/A521G/H748Y/ P750S/R820 A, S40A/P85E/V102S/V132Y/S157G/I262L/ S263A/T299N/L476N/A521G/H748Y/P750S/R820A, L20C/F21C/S40A/P85E/V102S/V132Y/S157G/I262L/ S263A/A521G/H748Y/P750S, F21C/S40A/V102S/V132Y/ S157G/I262L/S263A/A521G/H748Y, S40A/P85E/V102S/ V132Y/S157G/I262L/S263A/A521G/Y705W/H748Y/ P750S, F21C/S40A/P85E/V102S/V132Y/S157G/I262L/ S263A/R386V/L476N/A521G/H748Y/P750S/R820 A, S40A/P85E/V102S/V132Y/S157G/I262L/S263A/A521G/ H748Y/P750S/R820A, F21C/S40A/P85E/V102S/V132Y/ S157G/I262L/S263A/T299N/R322N/A521G/H748Y/ P750S, L20C/S40A/P85E/V102S/V132Y/S157G/I262L/ S263A/R322N/R386V/A521G/H748Y/P750S/R820 A, S40A/P85E/V102S/V132Y/S157G/I262L/S263A/T299N/ A521G/H748Y/P750S, F21C/S40A/P85E/V102S/V132Y/ S157G/I262L/S263A/T299N/R386V/L476N/A521G/ H748Y/P750 S, S40A/P85E/V102S/K109P/V132Y/S157G/ I262L/S263A/A521G/H748Y/P750S, S40A/P85E/V102S/ V132Y/S157G/I262L/S263A/R322N/R495E/A521G/ H748Y/P750S, S40A/P85E/V102S/V132Y/S157G/I262L/ S263A/A491G/A521G/H748Y/P750S, S40A/S52R/P85E/ V102S/V132Y/S157G/I262L/S263A/A521G/H748Y/ P750S/R820A, F21C/S40A/P85E/V102S/V132Y/S157G/ I262L/S263A/R386V/A521G/H748Y/P750S/R820A, L20C/F21C/S40A/P85E/V102S/V132Y/S157G/I262L/ S263A/R495E/A521G/H748Y/P750S, F21C/S40A/P85E/ V102S/V132Y/S157G/I262L/S263A/T299N/R322N/ R495E/A521G/D566A/H748 Y/P750S/R820A, L20C/ F21C/S40A/P85E/V102S/V132Y/S157G/I262L/S263A/ T299N/R495E/A521G/H748Y/P750S, S40A/P85E/V102S/ V132Y/S157G/I262L/S263A/A521G/H748Y/P750S/ A756T, S40A/P85E/V102S/V132Y/S157G/I262L/S263A/ R386V/A521G/H748Y/P750S/R820A, S40A/P85E/V102S/ V132Y/S157G/I262L/S263A/R495E/A521G/H748Y/ P750S, S40A/P85E/V102S/V132Y/S157G/I262L/S263A/ T511M/A521G/H748Y/P750S, F21C/S40A/S52R/P85E/ V102S/V132Y/S157G/I262L/S263A/P242Q/R386V/ R495E/A521G/H748Y/P750S/R820A; S40A/P85E/V102S/ V132Y/S157G/I262L/S263A/T299N/L476N/R495E/ A521G/H748Y/P750S, S40A/P85E/V102S/V132Y/S157G/ I262L/S263A/A521G/G706E/H748Y/P750S, F21C/S40A/ P85E/V102S/V132Y/S157G/I262L/S263A/T299N/R386V/ L476N/R495E/A521G/H748 Y/P750S, F21C/S40A/P85E/ V102S/V132Y/S157G/I262L/S263A/T299N/R322N/ R495E/A521G/H748Y/P750S, F21C/S40A/P85E/V102S/ V132Y/S157G/I262L/S263A/L476N/A521G/H748Y/ P750S/A849T, S40A/P85E/V102S/V132Y/S157G/I262L/ S263A/T299N/R322N/L476N/A521G/H748Y/P750S/R820 A, F21C/S40A/S52R/P85E/V102S/V132Y/S157G/I262L/ S263A/T299N/R322N/A521G/H748Y/P750S/R820A, L20C/F21C/S40A/P85E/V102S/V132Y/S157G/I262L/ S263A/A521G/D566A/H748Y/P750S, L20C/S40A/S52R/ P85E/V102S/V132Y/S157G/I262L/S263A/A521G/H748Y/ P750S, S40A/P85E/V102S/V132Y/S157G/I262L/S263A/ R322N/R386V/R495E/A521G/D566A/H748Y/P750S/ R820A, F21C/S40A/P85E/V102S/V132Y/S157G/I262L/ S263A/T299N/A521G/H748Y/P750S, F21C/S40A/P85E/ V102S/V132Y/S157G/I262L/S263A/T299N/R386V/ A521G/H748Y/P750S, S40A/P85E/V102S/V132Y/S157G/ I262L/S263A/R386V/A521G/H748Y/P750S/A849T, S40A/S52R/P85E/V102S/V132Y/S157G/I262L/S263A/ L476N/A521G/H748Y/P750S, S40A/S52R/P85E/V102S/ V132Y/S157G/I262L/S263A/T299N/R322N/R386V/ R495E/A521G/H748 Y/P750S, or S40A/P85E/V102S/ V132Y/S157G/I262L/S263A/440/A521G/H748Y/P750S, wherein the amino acid positions are relative to the reference sequence of SEQ ID NO: 2.

In some embodiments, an engineered DNA polymerase, or fragment thereof, comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606.

In some embodiments, the engineered DNA polymerase, or a fragment thereof, comprises a polypeptide sequence having at least 75%, 80%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to the reference sequence corresponding to SEQ ID NO: 8, 332, 462, or 606, with the proviso that the polypeptide sequence does not include the sequence corresponding to residues 12 to 850 of SEQ ID NO:2.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606, wherein the polypeptide sequence comprises one or more substitutions relative to the reference sequence corresponding to residues 12 to 850 of SEQ ID NO: 8, 332, 462, or 606, or to the reference sequence corresponding to SEQ ID NO: 8, 332, 462, or 606.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 332, 462, or 606, or to a reference sequence corresponding to SEQ ID NO: 332, 462, or 606, wherein the polypeptide sequence comprises one or more substitutions relative to the reference sequence corresponding to residues 12 to 850 of SEQ ID NO: 8, or to the reference sequence corresponding to SEQ ID NO: 8.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 462 or 606, or to a reference sequence corresponding to SEQ ID NO: 462 or 606, wherein the polypeptide sequence comprises one or more substitutions relative to the reference sequence corresponding to residues 12 to 850 of SEQ ID NO: 332, or to the reference sequence corresponding to SEQ ID NO: 332.

In some embodiments of the foregoing, the polypeptide sequence of the engineered DNA polymerase comprises at least a substitution at amino acid position 15, 16, 20, 21, 22, 40, 41, 52, 57, 58, 73, 85, 87, 88, 91, 102, 109, 132, 157, 177, 186, 200, 213, 217, 231, 232, 242, 243, 262, 263, 264, 265, 273, 299, 321, 322, 328, 384, 386, 401, 402, 403, 404, 406, 407, 440, 476, 480, 491, 495, 498, 503, 504, 506, 507, 508, 511, 514, 520, 521, 523, 524, 525, 526, 527, 528, 529, 530, 533, 534, 535, 536, 537, 538, 539, 540, 542, 553, 554, 555, 556, 557, 558, 559, 560, 562, 563, 566, 570, 572, 581, 582, 584, 585, 586, 587, 589, 592, 593, 594, 595, 596, 597, 599, 601, 602, 603, 605, 607, 616, 665, 671, 674, 675, 677, 684, 688, 696, 704, 705, 706, 728, 735, 747, 748, 749, 750, 751, 753, 755, 756, 762, 763, 764, 766, 772, 773, 779, 793, 803, 814, 820, or 849, or combinations thereof, wherein the amino acid positions are relative to the reference sequence of SEQ ID NO: 8, 332, 462, or 606.

In some embodiments of the foregoing, the polypeptide sequence of the engineered DNA polymerase comprises at least an amino acid residue 15A/G/K/N, 16R, 20A/C, 21K/Q/S, 22K, 40A, 41F, 52R, 57T, 58N, 73A, 85E/P/R/S, 87N, 88T, 91K, 102V/M/S, 109P, 132Y, 157G, 177T, 186E, 200V, 213P, 217E, 231E, 232C, 242Q, 243L/S, 262L, 263A, 264T, 265I, 273M, 299N, 321G, 322N/S, 328I, 384Y, 386V, 401 A/G/I, 402G/R, 403L/R, 404S/T, 406K/Q, 407R/W, 440G, 476I/N, 480E/V/W, 491G, 495E/M/S, 498D, 503I/V, 504M, 506P, 507K, 508H, 511M, 514F, 520P, 521G/W/Y, 523A/K/V, 524G/K/Q, 525L/V, 526T, 527V/W, 528A/Q/R/W, 529S, 530G/P/R/W, 533L/P/Q/V, 534H/W, 535K, 536R, 537G/L/W, 538A, 539L/R, 540H/V, 542G/M/T/W, 553F/K/N/R, 554E, 555H/K/M/W, 556F/M/P/W, 557G/H, 558R/S/V/Q, 559D/G/P, 560G/M, 562S, 563L, 566A, 570R, 572I, 581A, 582F, 584N, 585KR, 586M, 587Q/S, 589G/L/R/S/W, 592G/T/V, 593N, 594C/Q/T/V/W, 595A/P/R, 596L/R/W, 597E, 599G/S/T, 601M/P, 602V, 603G/V/W, 605E/A, 607N, 616A, 665V, 671E/R, 674T, 675L, 677M, 684V, 688I, 696H/V, 704P, 705W, 706E, 728K, 735G/L, 747T, 748Y, 749L/R/T, 750S/P, 751H, 753K/V, 755P, 756N/T, 762M/Q/V, 763G/Y, 764A/I/V, 766Y, 772I, 773R, 779I, 793G, 803C/R, 814E, 820A, or 849T, or combinations thereof, wherein the amino acid positions are relative to the reference sequence of SEQ ID NO: 8, 332, 462, or 606.

In some embodiments, the polypeptide sequence of the engineered DNA polymerase comprises at least a substitution at amino acid position 40, 85, 102, 132, 157, 177, 262, 263, 521, 748, or 750, or combinations thereof, wherein the amino acid positions are relative to the reference sequence of SEQ ID NO: 8, 332, 462, or 606.

In some embodiments, the polypeptide sequence of the engineered DNA polymerase comprises at least an amino acid residue 40A, 85E, 102S, 132Y, 177T, 157G, 262L, 263A, 521G, 748Y, or 750S, or combinations thereof, wherein the amino acid positions are relative to the reference sequence of SEQ ID NO: 8, 332, 462, or 606.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, or to a reference sequence corresponding to SEQ ID NO: 8, wherein the polypeptide sequence comprises one or more substitutions relative to the reference sequence corresponding to residues 12 to 850 of SEQ ID NO: 8, or to the reference sequence corresponding to SEQ ID NO: 8.

In some embodiments, the polypeptide sequence of the engineered DNA polymerase comprises at least a substitution or substitution set at amino acid position: 22/407, 328, 401, 402, 403, 404, 406, 407, 503, 504, 506, 521, 523, 524, 525, 526, 527, 528, 529, 530, 531, 533, 534, 535, 536, 537, 538, 539, 540, 542, 553, 554, 555, 556, 557, 558, 559, 560, 563, 581, 582, 585, 586, 587, 589, 592, 592, 592, 593, 594, 595, 596, 597, 598, 599, 601, 602, 603, 605, 607, 696, 747, 749, 751, 762, 763, 764, 766, 773, 803, or 403/553, wherein the amino acid positions are relative to the reference sequence of SEQ ID NO: 8.

In some embodiments, the polypeptide sequence of the engineered DNA polymerase comprises at least a substitution or substitution set 599S, 530G, 596L, 696H, 542W, 530R, 553F, 533V, 555M, 594V, 594W, 536R, 585K, 401G, 597E, 553K, 402R, 763Y, 762V, 605E, 530P, 506P, 589G, 558S, 553N, 559P, 751H, 589S, 747T, 560M, 696V, 540V, 594C, 556W, 589R, 407W, 557H, 559G, 599T, 521Y, 605A, 559D, 534H, 592G, 533P, 529S, 524G, 749R, 766Y, 556P, 595P, 533Q, 603V, 537G, 589W, 598W, 22K/407R, 555W, 539R, 531Q, 581A, 803R, 538A, 404T, 406Q, 537L, 595R, 534W, 404S, 592V, 521W, 603G, 401I, 595A, 762Q, 530W, 558V, 527W, 596W, 603W, 528W, 504M, 587Q, 587S, 523V, 521G, 558R, 558Q, 593N, 525V, 749L, 503V, 527V, 554E, 535K, 592T, 528A, 585R, 401A, 586M, 764I, 556M, 763G, 406K, 582F, 540H, 560G, 402G, 594Q, 539L, 602V, 523A, 749T, 542T, 764A, 523K, 607N, 525L, 403L, 526T, 528R, 599G, 537W, 803C, 556F, 557G, 601M, 596R, 563L, 601P, 773R, 553R, 542M, 594T, 533L, 328I, 555K, 542G, 528Q, or 403R/553K, wherein the amino acid positions are relative to the reference sequence of SEQ ID NO: 8.

In some embodiments, the polypeptide sequence of the engineered DNA polymerase comprises at least a substitution or substitution set N599S, K530G, S596L, R696H, R542W, K530R, Q553F, T533V, R555M, S594V, S594W, S536R, Q585K, S401G, D597E, Q553K, N402R, A763Y, A762V, I605E, K530P, R506P, A589G, A558S, Q553N, K559P, E751H, A589S, R747T, L560M, R696V, T540V, S594C, E556W, A589R, S407W, L557H, K559G, N599T, A521Y, I605A, K559D, S534H, R592G, T533P, G529S, R524G, V749R, V766Y, E556P, S595P, T533Q, I603V, V537G, A589W, P598W, Q22K/S407R, R555W, E539R, R531Q, T581A, H803R, L538A, Q404T, A406Q, V537L, S595R, S534W, Q404S, R592V, A521W, I603G, S401I, S595A, A762Q, K530W, A558V, K527W, S596W, I603W, T528W, N504M, G587Q, G587S, R523V, A521G, A558R, A558Q, L593N, T525V, V749L, L503V, K527V, Y554E, A535K, R592T, T528A, Q585R, S401A, T586M, E764I, E556M, A763G, A406K, R582F, T540H, L560G, N402G, S594Q, E539L, N602V, R523A, V749T, R542T, E764A, R523K, T607N, T525L, N403L, A526T, T528R, N599G, V537W, H803C, E556F, L557G, Q601M, S596R, T563L, Q601P, Q773R, Q553R, R542M, S594T, T533L, V328I, R555K, R542G, T528Q, or N403R/Q553K, wherein the amino acid positions are relative to the reference sequence of SEQ ID NO: 8.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 332, or to a reference sequence corresponding to SEQ ID NO: 332, wherein the polypeptide sequence comprises one or more substitutions relative to the reference sequence corresponding to residues 12 to 850 of SEQ ID NO: 332, or to the reference sequence corresponding to SEQ ID NO: 332.

In some embodiments, the polypeptide sequence of the engineered DNA polymerase comprises at least a substitution or substitution set at amino acid position 15, 20, 21, 52, 85, 87, 91, 102, 243, 321, 322, 384, 404, 476, 480, 480, 495, 542, 570, 671, 675, 704, 728, 735, 753, 755, 762, 764, 793, 820, 16/735, 750/849, 524/581, 403/404/524/542/555/762/764, 404/524/542/589/762/764, 524/542/581/762/764, 542/762/764, wherein the amino acid positions are relative to the reference sequence of SEQ ID NO: 332.

In some embodiments, the polypeptide sequence of the engineered DNA polymerase comprises at least a substitution or substitution set 404S, 542G, 762M, 524Q/542G/581A/762M/764V, 404S/524Q/542G/589L/762M/764V, 764V, 403R/404S/524Q/542G/555H/762M/764V, 476N, 542G/762M/764V, 728K, 52R, 476I, 675L, 750S/849T, 102S, 21C, 755P, 21S, 321G, 20A, 21K, 87N, 20C, 16R/735L, 21Q, 704P, 735G, 384Y, 480W, 102M, 793G, 322S, 322N, 570R, 480V, 753V, 753K, 524Q/581A, 91K, 243L, 243S, 671E, 85S, 495M, 15A, 15N, 15K, 820A, 495E, 85E, 85R, 480E, 15G, or 671R, wherein the amino acid positions are relative to the reference sequence of SEQ ID NO: 332.

In some embodiments, the polypeptide sequence of the engineered DNA polymerase comprises at least a substitution or substitution set Q404S, R542G, A762M, R524Q/R542G/T581A/A762M/E764V, Q404S/R524Q/R542G/A589L/A762M/E764V, E764V, N403R/Q404S/R524Q/R542G/R555H/A762M/E764V, L476N, R542G/A762M/E764V, R728K, S52R, L476I, P675L, P750S/A849T, V102S, F21C, K755P, F21S, E321G, L20A, F21K, P87N, L20C, Q16R/E735L, F21Q, D704P, E735G, R384Y, Q480W, V102M, P793G, R322S, R322N, K570R, Q480V, L753V, L753K, R524Q/T581A, H91K, P243L, P243S, V671E, P85S, R495M, V15A, V15N, V15K, R820A, R495E, P85E, P85R, Q480E, V15G, or V671R, wherein the amino acid positions are relative to the reference sequence of SEQ ID NO: 332.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 462, or to a reference sequence corresponding to SEQ ID NO: 462, wherein the polypeptide sequence comprises one or more substitutions relative to the reference sequence corresponding to residues 12 to 850 of SEQ ID NO: 462, or to the reference sequence corresponding to SEQ ID NO: 462.

In some embodiments, the polypeptide sequence of the engineered DNA polymerase comprises at least a substitution or substitution set at amino acid position: 750/820, 21/52, 20/21/85/322/476/495, 20/85/200/322/476/495/750, 476/750, 20/476, 20/322/386, 85/322/476, 52/322/498/750, 20/322/476/820, 85/476/495/820, 21/85/322/820, 20/299/322/386/476/495/820, 20/322, 21/820/849, 476, 322/820, 21/322/386/820, 322/386/495, 85/386/495/750, 20/85/476/750, 20/386/476, 85/322/386/476/495, 20/495/820, 750, 21/322/495, 52/386/495/820, 21/322, 85/322/750/820, 20/52/85, 21/52/572, 20/85/495/849, 85/750, 21/495/820, 273/322/849, 495, 322/750/820, 52/476/495/566/750/849, 386/495, 495/820, 21/322/495/750/820, 21/85/322/386/495/820/849, 476/495/750, 386/849, 476/495, 85/476/849, 21/322/750, 20/85/566/820, 386/750/849, or combinations thereof, wherein the amino acid positions are relative to the reference sequence of SEQ ID NO: 462.

In some embodiments, the polypeptide sequence of the engineered DNA polymerase comprises at least a substitution or substitution set 750S/820A, 21C/52R, 20C/21C/85E/322N/476N/495E, 20C/85E/200V/322N/476N/495S/750S, 476N/750S, 20C/476N, 20C/322N/386V, 85E/322N/476N, 52R/322N/498D/750S, 20C/322N/476N/820A, 85E/476N/495E/820A, 21C/85E/322N/820A, 20C/299N/322N/386V/476N/495E/820A, 20C/322N, 21C/820A/849T, 476N, 322N/820A, 21C/322N/386V/820A, 322N/386V/495E, 85E/386V/495E/750S, 20C/85E/476N/750S, 20C/386V/476N, 85E/322N/386V/476N/495S, 20C/495E/820A, 750S, 21C/322N/495E, 52R/386V/495S/820A, 21C/322N, 85E/322N/750S/820A, 20C/52R/85E, 21C/52R/572I, 20C/85E/495E/849T, 85E/750S, 21C/495E/820A, 273M/322N/849T, 495E, 322N/750S/820A, 52R/476N/495E/566A/750S/849T, 386V/495E, 495S/820A, 21C/322N/495E/750S/820A, 21C/85E/322N/386V/495S/820A/849T, 495S, 476N/495E/750S, 386V/849T, 476N/495E, 85E/476N/849T, 21C/322N/750S, 20C/85E/566A/820A, or 386V/750S/849T, wherein the amino acid positions are relative to the reference sequence of SEQ ID NO: 462.

In some embodiments, the polypeptide sequence of the engineered DNA polymerase comprises at least a substitution or substitution set P750S/R820A, F21C/S52R, L20C/F21C/P85E/R322N/L476N/R495E, L20C/P85E/A200V/R322N/L476N/R495S/P750S, L476N/P750S, L20C/L476N, L20C/R322N/R386V, P85E/R322N/L476N, S52R/R322N/G498D/P750S, L20C/R322N/L476N/R820A, P85E/L476N/R495E/R820A, F21C/P85E/R322N/R820A, L20C/T299N/R322N/R386V/L476N/R495E/R820A, L20C/R322N, F21C/R820A/A849T, L476N, R322N/ R820A, F21C/R322N/R386V/R820A, R322N/R386V/ R495E, P85E/R386V/R495E/P750S, L20C/P85E/L476N/ P750S, L20C/R386V/L476N, P85E/R322N/R386V/L476N/ R495S, L20C/R495E/R820A, P750S, F21C/R322N/R495E, S52R/R386V/R495S/R820A, F21C/R322N, P85E/R322N/ P750S/R820A, L20C/S52R/P85E, F21C/S52R/V572I, L20C/P85E/R495E/A849T, P85E/P750S, F21C/R495E/ R820A, V273M/R322N/A849T, R495E, R322N/P750S/ R820A, S52R/L476N/R495E/D566A/P750S/A849T, R386V/R495E, R495S/R820A, F21C/R322N/R495E/ P750S/R820A, F21C/P85E/R322N/R386V/R495S/R820A/ A849T, R495S, L476N/R495E/P750S, R386V/A849T, L476N/R495E, P85E/L476N/A849T, F21C/R322N/P750S, L20C/P85E/D566A/R820A, or R386V/P750S/A849T, wherein the amino acid positions are relative to the reference sequence of SEQ ID NO: 462.

In some embodiments, the engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 606, or to a reference sequence corresponding to SEQ ID NO: 606, wherein the polypeptide sequence comprises one or more substitutions relative to the reference sequence corresponding to residues 12 to 850 of SEQ ID NO: 606, or to the reference sequence corresponding to SEQ ID NO: 606.

In some embodiments, the polypeptide sequence of the engineered DNA polymerase comprises at least a substitution or substitution set at amino acid position 299/386/566/ 820, 476/820/849, 21/322/476/495/820, 177, 21/495, 476/ 820, 20/52/299, 52/299, 322/820, 20/820, 20/299/386/476, 386/476/820, 476/495/820, 386/476/495, 20/21/299/322/ 386, 322/386/495, 21/299/322/476/495/820, 21/299/386/ 820, 299/476/820, 20/21, 21/85/102/750, 705, 21/386/476/ 820, 820, 21/299/322, 20/21/322/386/820, 299, 21/299/386/ 476, 109, 322/495, 491, 52/820, 21/386/820, 20/21/495, 21/299/322/495/566/820, 20/21/299/495, 756, 386/820, 495, 511, 21/52/242/386/495/820, 299/476/495, 706, 21/299/386/476/495, 21/299/322/495, 21/476/849, 299/322/ 476/820, 21/52/299/322/820, 20/21/566, 20/52, 322/386/ 495/566/820, 21/299, 21/299/386, 386/849, 52/476, 52/299/ 322/386/495, or 440, wherein the amino acid positions are relative to the reference sequence of SEQ ID NO: 606.

In some embodiments, the polypeptide sequence of the engineered DNA polymerase comprises at least a substitution or substitution set 299N/386V/566A/820A, 476N/ 820A/849T, 21C/322N/476N/495E/820A, 177T, 21C/495E, 476N/820A, 20C/52R/299N, 52R/299N, 322N/820A, 20C/ 820A, 20C/299N/386V/476N, 386V/476N/820A, 476N/ 495E/820A, 386V/476N/495E, 20C/21C/299N/322N/386V, 322N/386V/495E, 21C/299N/322N/476N/495E/820A, 21C/299N/386V/820A, 299N/476N/820A, 20C/21C, 21C/ 85P/102V/750P, 705W, 21C/386V/476N/820A, 820A, 21C/ 299N/322N, 20C/21C/322N/386V/820A, 299N, 21C/299N/ 386V/476N, 109P, 322N/495E, 491G, 52R/820A, 21C/ 386V/820A, 20C/21C/495E, 21C/T99N/322N/495E/566A/ 820A, 20C/21C/299N/495E, 756T, 386V/820A, 495E, 511M, 21C/52R/242Q/386V/495E/820A, 299N/476N/ 495E, 706E, 21C/299N/386V/476N/495E, 21C/299N/ 322N/495E, 21C/476N/849T, 299N/322N/476N/820A, 21C/52R/299N/322N/820A, 20C/21C/566A, 20C/52R, 322N/386V/495E/566A/820A, 21C/299N, 21C/299N/386V, 386V/849T, 52R/476N, 52R/299N/322N/386V/495E, or 440G, wherein the amino acid positions are relative to the reference sequence of SEQ ID NO: 606.

In some embodiments, the polypeptide sequence of the engineered DNA polymerase comprises at least a substitution or substitution set T299N/R386V/D566A/R820A, L476N/R820A/A849T, F21C/R322N/L476N/R495E/ R820A, R177T, F21C/R495E, L476N/R820A, L20C/S52R/ T299N, S52R/T299N, R322N/R820A, L20C/R820A, L20C/T299N/R386V/L476N, R386V/L476N/R820A, L476N/R495E/R820A, R386V/L476N/R495E, L20C/ F21C/T299N/R322N/R386V, R322N/R386V/R495E, F21C/T299N/R322N/L476N/R495E/R820A, F21C/T299N/ R386V/R820A, T299N/L476N/R820A, L20C/F21C, F21C/ E85P/S102V/S750P, Y705W, F21C/R386V/L476N/R820A, R820A, F21C/T299N/R322N, L20C/F21C/R322N/R386V/ R820A, T299N, F21C/T299N/R386V/L476N, K109P, R322N/R495E, A491G, S52R/R820A, F21C/R386V/ R820A, L20C/F21C/R495E, F21C/T299N/R322N/R495E/ D566A/R820A, L20C/F21C/T299N/R495E, A756T, R386V/R820A, R495E, T511M, F21C/S52R/P242Q/ R386V/R495E/R820A, T299N/L476N/R495E, G706E, F21C/T299N/R386V/L476N/R495E, F21C/T299N/R322N/ R495E, F21C/L476N/A849T, T299N/R322N/L476N/ R820A, F21C/S52R/T299N/R322N/R820A, L20C/F21C/ D566A, L20C/S52R, R322N/R386V/R495E/D566A/ R820A, F21C/T299N, F21C/T299N/R386V, R386V/ A849T, S52R/L476N, S52R/T299N/R322N/R386V/R495E, or E440G, wherein the amino acid positions are relative to the reference sequence of SEQ ID NO: 606.

In some embodiments, the engineered DNA polymerase comprises a polypeptide sequence comprising a substitution in at least one amino acid position provided in Table 4.1, 5.1, 6.1, 7.1, and 8.1, wherein the substitution is relative to the reference sequence corresponding to residues 12 to 850 of SEQ ID NO: 2, 8, 332, 462, or 606, or to the reference sequence corresponding to SEQ ID NO: 2, 8, 332, 462, or 606.

In some embodiments, the engineered DNA polymerase comprises a polypeptide sequence comprising at least one substitution provided in Table 4.1, 5.1, 6.1, 7.1, and 8.1, wherein the substitution is relative to the reference sequence comprising residues 12 to 850 of SEQ ID NO: 2, 8, 332, 462, or 606, or to the reference sequence of SEQ ID NO: 2, 8, 332, 462, or 606.

In some embodiments, the engineered DNA polymerase comprises a polypeptide sequence comprising at least a substitution or substitution set provided in Table 4.1, 5.1, 6.1, 7.1, and 8.1, wherein the substitution or substitution set is relative to the reference sequence comprising residues 12 to 850 of SEQ ID NO: 2, 8, 332, 462, or 606, or to the reference sequence of SEQ ID NO: 2, 8, 332, 462, or 606.

In some embodiments, an engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to residues 12 to 850 of an even numbered SEQ ID NO. set forth in Table 4.1, 5.1, 6.1, 7.1, and 8.1, or to a reference sequence of an even numbered SEQ ID NO. set forth in Table 4.1, 5.1, 6.1, 7.1, and 8.1. In some embodiments, the engineered DNA polymerase comprises a polypeptide sequence comprising residues 12 to 850 of an even numbered SEQ ID NO. set forth in Table 4.1, 5.1, 6.1, 7.1, and 8.1, or a polypeptide sequence comprising an even numbered SEQ ID NO. set forth in Table 4.1, 5.1, 6.1, 7.1, and 8.1.

In some embodiments, an engineered DNA polymerase comprises a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to residues 12 to 850 of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 7762, 764, 766, 768, or 770.

In some embodiments, the engineered DNA polymerase comprises a polypeptide sequence comprising residues 12 to 850 of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 7762, 764, 766, 768, or 770, or a fragment thereof, wherein the polypeptide optionally has 1, 2, 3, 4, 5, 6, 7, 8, 9, or up to 10 substitutions in the polypeptide sequence.

In some embodiments, an engineered DNA polymerase comprises a polypeptide sequence comprising at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 7762, 764, 766, 768, or 770.

In some embodiments, the engineered DNA polymerase comprises a polypeptide sequence comprising SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 7762, 764, 766, 768, or 770, or a fragment thereof, wherein the polypeptide optionally has 1, 2, 3, 4, 5, 6, 7, 8, 9, or up to 10 substitutions in the polypeptide sequence.

In some embodiments, the engineered DNA polymerase polypeptide has 1, 2, 3, 4, or up to 5 substitutions in the polypeptide sequence. In some embodiments, the engineered DNA polymerase polypeptide has 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions. In some embodiments, guidance on non-conservative and conservative substitutions are provided by the variants disclosed herein, including in the Examples.

In some embodiments, the engineered DNA polymerase comprises a polypeptide sequence comprising residues 12 to 850 of SEQ ID NO: 2, 8, 332, 462, or 606, wherein the polypeptide sequence has optionally 1, 2, 3, 4, 5, 6, 7, 8, 9, or up to 10 substitutions in the polypeptide sequence. In some embodiments, the engineered DNA polymerase comprises a polypeptide sequence comprising SEQ ID NO: 2, 8, 332, 462, or 606, wherein the polypeptide sequence has optionally 1, 2, 3, 4, 5, 6, 7, 8, 9, or up to 10 substitutions in the polypeptide sequence. In some embodiments, the engineered DNA polymerase includes 1, 2, 3, 4, up to 5 substitutions in the polypeptide sequence. In some embodiments, the engineered DNA polymerase includes 1, 2, 3, or 4 substitutions in the polypeptide sequence.

It will be apparent that the description herein, including the Examples and Tables, provide structural information correlating specific amino acid sequence features with the functional activity/properties of the engineered DNA polymerase polypeptides. This structure-function correlation information is provided in the form of specific amino acid residue differences relative to the reference engineered polypeptide of SEQ ID NO: 2, 8, 332, 462, or 606, as well as associated experimentally determined activity data for the exemplary engineered DNA polymerase polypeptides. Such information provide guidance and information on substitutions implemented in preparing engineered DNA polymerase variants.

In some embodiments, the engineered DNA polymerase of the present disclosure has DNA polymerase activity. In some embodiments, the engineered DNA polymerase has at least one improved property as compared to a reference or comparator DNA polymerase. In some embodiments, the engineered DNA polymerase has one or more of improved property selected from increased activity; increased DNA product yield; increased thermostability; increased processivity; increased fidelity; increased DNA template sensitivity, and increased product yield in a PCR reaction, compared to a reference or comparator DNA polymerase. In some embodiments, the reference or comparator DNA polymerase has a sequence corresponding to residues 12 to 850 of SEQ ID NO: 2, 8, 332, 462, or 606, or a sequence corresponding to SEQ ID NO: 2, 8, 332, 462, or 606. In some embodiments, the reference DNA polymerase has the sequence corresponding to residues 12 to 850 of SEQ ID NO: 2, or the sequence corresponding to SEQ ID NO: 2. In some embodiments, the reference or comparator DNA polymerase is a wild-type DNA polymerase selected from Pfu DNA polymerase from *Pyrococcus furiosus*, Group B DNA polymerase from *Thermococcus* sp. strain 2319x1, and Taq DNA polymerase from *Thermus aquaticus*.

In some embodiments, the engineered DNA polymerase polypeptide described herein is an isolated composition. In some embodiments, the engineered DNA polymerase polypeptide is a purified composition, as further discussed herein.

In some embodiments, the present disclosure further provides functional fragments or biologically active fragments of an engineered DNA polymerase polypeptides described herein. Thus, for each and every embodiment herein of an engineered DNA polymerase, a functional fragment or biologically active fragment of the engineered DNA polymerase is provided herewith. In some embodiments, a functional fragment or biologically active fragments of an engineered DNA polymerase comprises at least about 90%, at least about 95%, at least about 96%, at least about 97%, at least about 98%, or at least about 99% of the activity of the DNA polymerase polypeptide from which it was derived (i.e., the parent DNA polymerase).

In some embodiments, functional fragments or biologically active fragments comprise at least about 90%, at least about 91%, at least about 92%, at least about 93%, at least about 94%, at least about 95%, at least about 96%, at least about 97%, at least about 98%, or at least about 99% of the parent sequence of the DNA polymerase. In some embodiments the functional fragment will be truncated by less than 5, less than 10, less than 15, less than 10, less than 25, less than 30, less than 35, less than 40, less than 45, and less than 50 amino acids.

In some embodiments, a functional fragment of an engineered DNA polymerase herein comprises at least 90%, 91%, 92%, 93%, 94%, 95%, 96%, 97%, 98%, or 99% of the parent sequence of the engineered DNA polymerase. In some embodiments the functional fragment will be truncated by less than 5, less than 10, less than 15, less than 10, less than 25, less than 30, less than 35, less than 40, less than 45, less than 50, less than 55, less than 60, less than 65, or less than 70 amino acids.

In some embodiments, the functional fragments or biologically active fragments of the engineered DNA polymerase polypeptide described herein include at least a substitution or substitution set in the amino acid sequence of the engineered DNA polymerase described herein. Accordingly, in some embodiments, the functional fragments or biologically active fragments of the engineered DNA polymerase displays the enhanced or improved property associated with the substitution or substitution set in the parent engineered DNA polymerase.

Polynucleotides Encoding Engineered Polypeptides, Expression Vectors and Host Cells In another aspect, the present disclosure provides recombinant polynucleotides encoding the engineered DNA polymerase polypeptides described herein. In some embodiments, the recombinant polynucleotides are operatively linked to one or more heterologous regulatory sequences that control gene expression to create a DNA polymerase capable of expressing the polypeptide. In some embodiments, expression constructs containing at least one heterologous polynucleotide encoding the engineered DNA polymerase polypeptide(s) is introduced into appropriate host cells to express the corresponding DNA polymerase polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered DNA polymerase polypeptide of the present disclosure. Thus, the present disclosure provides methods and compositions for the production of each and every possible variation of engineered DNA polymerase polynucleotides that could be made that encode the engineered DNA polymerase polypeptides described herein by selecting combinations based on the possible codon choices, and all such variations of recombinant polynucleotides are to be considered specifically disclosed for any polypeptide described herein, including the amino acid sequences presented in the Examples (e.g., in Tables 4.1, 5.1, 6.1, 7.1, and 8.1) and in the Sequence Listing.

In some embodiments, the codons are preferably optimized for utilization by the chosen host cell for protein production. For example, preferred codons used in bacteria are typically used for expression in bacteria, and preferred codons used in mammalian cells are typically used for expression in mammalian cells. Consequently, codon optimized polynucleotides encoding the engineered DNA polymerase polypeptides contain preferred codons at about 40%, 50%, 60%, 70%, 80%, 90%, or greater than 90% of the codon positions in the full length coding region.

In some embodiments, the recombinant polynucleotide encodes the engineered DNA polymerase comprising a polypeptide acid sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 2, 8, 332, 462, or 606, or to a reference sequence corresponding to SEQ ID NO: 2, 8, 332, 462, or 606, wherein the polypeptide sequence comprises one or more substitutions relative to the reference sequence corresponding to residues 12 to 850 of SEQ ID NO: 2, 8, 332, 462, or 606, or to the reference sequence corresponding to SEQ ID NO: 2, 8, 332, 462, or 606.

In some embodiments, the recombinant polynucleotide encodes the engineered DNA polymerase comprising a polypeptide acid sequence having at least at least 70%, 75%, 80%, 85%, 86%, 87%, 88%, 89%, 90%, 91%, 92%, 93%, 94%, 95%, 96%, 97%, 98%, or 99% or more sequence identity to a reference sequence corresponding to residues 12 to 850 of SEQ ID NO: 2, or to a reference sequence corresponding to SEQ ID NO: 2, wherein the polypeptide sequence comprises one or more substitutions relative to a reference sequence corresponding to residues 12 to 850 of SEQ ID NO: 2, or to a reference sequence corresponding to SEQ ID NO: 2, as described herein.

As described above, in some embodiments, the recombinant polynucleotide encodes the engineered DNA polymerase comprising a polypeptide acid sequence comprising at least a substitution at amino acid position 15, 16, 20, 21, 22, 40, 41, 52, 57, 58, 73, 85, 87, 88, 91, 102, 109, 132, 157, 177, 186, 200, 213, 217, 231, 232, 242, 243, 262, 263, 264, 265, 273, 299, 321, 322, 328, 384, 386, 401, 402, 403, 404, 406, 407, 440, 476, 480, 491, 495, 498, 503, 504, 506, 507, 508, 511, 514, 520, 521, 523, 524, 525, 526, 527, 528, 529, 530, 533, 534, 535, 536, 537, 538, 539, 540, 542, 553, 554, 555, 556, 557, 558, 559, 560, 562, 563, 566, 570, 572, 581, 582, 584, 585, 586, 587, 589, 592, 593, 594, 595, 596, 597, 599, 601, 602, 603, 605, 607, 616, 665, 671, 674, 675, 677, 684, 688, 696, 704, 705, 706, 728, 735, 747, 748, 749, 750, 751, 753, 755, 756, 762, 763, 764, 766, 772, 773, 779, 793, 803, 814, 820, or 849, or combinations thereof, wherein the amino acid positions are relative to the reference sequence of SEQ ID NO: 2.

In some embodiments, the recombinant polynucleotide encodes the engineered DNA polymerase polypeptide comprising a polypeptide acid sequence comprising at least a substitution at amino acid position 40, 85, 102, 132, 157, 177, 262, 263, 503, 521, 748, or 750, or combinations thereof, wherein the amino acid positions are relative to the reference sequence of SEQ ID NO: 2.

In some embodiments, the recombinant polynucleotide encodes the engineered DNA polymerase polypeptide comprising a polypeptide acid sequence comprising at least a substitution or substitution set at amino acid position 213/503/508/584/748, 40/132/748, 40/132/157/262/263/748, 132, 40/132/503/748, 40/132/157/503/562, 40/132/213/748/814, 132/157/562/584, 132/584/748, 40/132/D231E/I684V/H748Y, 40/132, 40/41/132/562/684/748, 41/213/231/503/650/674/748, 132/231/503/748, 40/132Y/S157G/L503I, 503/748/814, 40/132/231/503/674/748, 40/88/132/503/684/748, 132/157/213/674/748/814, 157/263/748, 40/748, 41/157/231/262/748/814, 40/213/503/562/584/748, 523/524, 40/132/503/514/650/674, 40/132/157/213/231, 41/213/520/814, 40/41/157/231/503, 40/157/503, 40/132/562/748, 132/748, 40/41/132/562/748, 88/213/503/584/684/748, 57/58/523/616/677, 40/213/231/503/514/562/748, 132/562, 213/503/650, 40/41/88/231/748/814, 41/213/262/562, 41/88/231/748, 213/263/748, 40/157/213, 157/520, 40/132/263/503/674/814, 40/41, 524/665/756, 58/186/217/523/524/677, 40/41/748, 132/514, 520, 41/213/503/562, 231/503/748/772, 503/562, 73/232/514/584/814, 58/507/616, 132/262/520/562/684/748, 88/562/814, 41/88/157/814, 88/157/213/674/684, 57/58/523/779, 40/132/157/514/520/684, 40/41/213/684/772, 40/41/231/503/814, 88/213/503/584/814, 40/41/132/562/584, 41/88/213/231/503/650/748, 40/503, 40/132/213/231/520/562/650/814, 40/41/132/231/262/503/562/584/748/814, 57/58/264/265/524/688, 88/132/157/262/263/520/562, 88/132/157/262/503/514/562/650, 40/584/674/748, 40/41/132/263/503, 584/748, 40/213/674, 40/41/88T/132/503/562/584/748, 88/213/514/562/748/814, 263/520/814, or 40/41/88/157, wherein the amino acid positions are relative to the reference sequence of SEQ ID NO: 2.

In some embodiments, the recombinant polynucleotide encodes the engineered DNA polymerase polypeptide comprising a polypeptide acid sequence comprising at least a substitution or substitution set at amino acid position: 22/407, 328, 401, 402, 403, 404, 406, 407, 503, 504, 506, 521, 523, 524, 525, 526, 527, 528, 529, 530, 531, 533, 534, 535, 536, 537, 538, 539, 540, 542, 553, 554, 555, 556, 557, 558, 559, 560, 563, 581, 582, 585, 586, 587, 589, 592, 592, 592, 593, 594, 595, 596, 597, 598, 599, 601, 602, 603, 605, 607, 696, 747, 749, 751, 762, 763, 764, 766, 773, 803, or combinations thereof, wherein the amino acid positions are relative to the reference sequence of SEQ ID NO: 2.

In some embodiments, the recombinant polynucleotide encodes the engineered DNA polymerase polypeptide comprising a polypeptide acid sequence comprising at least a substitution or substitution set at amino acid position 15, 20, 21, 52, 85, 87, 91, 102, 243, 321, 322, 384, 404, 476, 480, 480, 495, 542, 570, 671, 675, 704, 728, 735, 753, 755, 762, 764, 793, 820, 16/735, 750/849, 524/581, 403/404/524/542/555/762/764, 404/524/542/589/762/764, 524/542/581/762/764, or 542/762/764, wherein the amino acid positions are relative to the reference sequence of SEQ ID NO: 2.

In some embodiments, the recombinant polynucleotide encodes the engineered DNA polymerase polypeptide comprising a polypeptide acid sequence comprising at least a substitution or substitution set at amino acid position 750/820, 21/52, 20/21/85/322/476/495, 20/85/200/322/476/495/750, 476/750, 20C/476, 20/322/386, 85/322/476, 52/322/498/750, 20/322/476/820, 85/476/495/820, 21/85/322/820, 20/299/322/386/476/495/820, 20/322, 21/820/849, 476, 322/820, 21/322/386/820, 322/386/495, 85/386/495/750, 20/85/476/750, 20/386/476, 85/322/386/476/495, 20/495/820, 750, 21/322/495, 52/386/495/820, 21/322, 85/322/750/820, 20/52/85, 21/52/572, 20/85/495/849, 85/750, 21/495/820, 273/322/849, 495, 322/750/820, 52/476/495/566/750/849, 386/495, 495/820, 21/322/495/750/820, 21/85/322/386/495/820/849, 476/495/750, 386/849, 476/495, 85/476/849, 21/322/750, 20/85/566/820, 386/750/849, or combinations thereof, wherein the amino acid positions are relative to the reference sequence of SEQ ID NO: 2.

In some embodiments, the recombinant polynucleotide encodes the engineered DNA polymerase polypeptide comprising a polypeptide sequence comprising at least a substitution or substitution set at amino acid position 299/386/566/820, 476/820/849, 21/322/476/495/820, 177, 21/495, 476/820, 20/52/299, 52/299, 322/820, 20/820, 20/299/386/476, 386/476/820, 476/495/820, 386/476/495, 20/21/299/322/386, 322/386/495, 21/299/322/476/495/820, 21/299/386/820, 299/476/820, 20/21, 21/85/102/750, 705, 21/386/476/820, 820, 21/299/322, 20/21/322/386/820, 299, 21/299/386/476, 109, 322/495, 491, 52/820, 21/386/820, 20/21/495, 21/299/322/495/566/820, 20/21/299/495, 756, 386/820, 495, 511, 21/52/242/386/495/820, 299/476/495, 706, 21/299/386/476/495, 21/299/322/495, 21/476/849, 299/322/476/820, 21/52/299/322/820, 20/21/566, 20/52, 322/386/495/566/820, 21/299, 21/299/386, 386/849, 52/476, 52/299/322/386/495, or 440, wherein the amino acid positions are relative to the reference sequence of SEQ ID NO: 2.

In some embodiments, the recombinant polynucleotide encodes the engineered DNA polymerase polypeptide comprising a substitution or substitution set at amino acid position 22/40/132/157/262/263/407/748, 40/132/157/262/263/328/748, 40/132/157/262/263/401/748, 40/132/157/262/263/402/748, 40/132/157/262/263/403/748, 40/132/157/262/263/404/748, 40/132/157/262/263/406/748, 40/132/157/262/263/407/748, 40/132/157/262/263/503/748, 40/132/157/262/263/504/748, 40/132/157/262/263/506/748, 40/132/157/262/263/521/748, 40/132/157/262/263/523/748, 40/132/157/262/263/524/748, 40/132/157/262/263/525/748, 40/132/157/262/263/526/748, 40/132/157/262/263/527/748, 40/132/157/262/263/528/748, 40/132/157/262/263/529/748, 40/132/157/262/263/530/748, 40/132/157/262/263/531/748, 40/132/157/262/263/533/748, 40/132/157/262/263/534/748, 40/132/157/262/263/535/748, 40/132/157/262/263/536/748, 40/132/157/262/263/537/748, 40/132/157/262/263/538/748, 40/132/157/262/263/539/748, 40/132/157/262/263/540/748, 40/132/157/262/263/542/748, 40/132/157/262/263/54/748, 40/132/157/262/263/553/748, 40/132/157/262/263/554/748, 40/132/157/262/263/555/748, 40/132/157/262/263/556/748, 40/132/157/262/263/557/748, 40/132/157/262/263/558/748, 40/132/157/262/263/559/748, 40/132/157/262/263/560/748, 40/132/157/262/263/563/748, 40/132/157/262/263/581/748, 40/132/157/262/263/582/748, 40/132/157/262/263/585/748, 40/132/157/262/263/586/748, 40/132/157/262/263/587/748, 40/132/157/262/263/589/748, 40/132/157/262/263/592/748, 40/132/157/262/263/593/748, 40/132/157/262/263/594/748, 40/132/157/262/263/595/748, 40/132/157/262/263/596/748, 40/132/157/262/263/597/748, 40/132/157/262/263/598/748, 40/132/157/262/263/599/748, 40/132/157/262/263/601/748, 40/132/157/262/263/602/748, 40/132/157/262/263/603/748, 40/132/157/262/263/605/748, 40/132/157/262/263/607/748, 40/132/157/262/263/696/748, 40/132/157/262/263/747/748, 40/132/157/262/263/748, 40/132/157/262/263/748/749, 40/132/157/262/263/748/751, 40/132/157/262/263/748/762, 40/132/157/262/263/748/763, 40/132/157/262/263/748/764, 40/132/157/262/263/748/766, 40/132/157/262/263/748/773, 40/132/157/262/263/748/803, 40/132/157/605/262/263/748, 40/132/157/262/263/403/521/748, or 40/132/157/262/263/403/553/748, wherein the amino acid positions are relative to the reference sequence of SEQ ID NO: 2.

In some embodiments, the recombinant polynucleotide encodes the engineered DNA polymerase polypeptide comprising a substitution or substitution set at amino acid position 40/132/157/262/263/403/404/521/524/542/555/748/762/764, 40/132/157/262/263/404/521/524/542/589/748/762/764, 40/132/157/262/263/521/524/542/581/748/762/764, 40/132/157/262/263/521/542/748/762/764, 40/132/157/262/263/404/521/542/748/762, 40/132/157/262/263/521/748/750/849, 40/132/157/262/263/521/524/581/748, 16/40/132/157/262/263/521/735/748, 40/132/157/262/263/521/748/820, 40/132/157/262/263/521/748/793, 40/132/157/262/263/521/748/764, 40/132/157/262/263/521/748/755, 40/132/157/262/263/521/748/753, 40/132/157/262/263/521/735/748, 40/132/157/262/263/521/748/728, 40/132/157/262/263/521/704/748, 40/132/157/262/263/521/675/748, 40/132/157/262/263/521/671/748, 40/132/157/262/263/521/570/748, 40/132/157/262/263/495/521/748, 40/132/157/262/263/480/521/748, 40/132/157/262/263/476/521/748, 40/132/157/262/263/384/521/748, 40/132/157/262/263/322/521/748, 40/132/157/262/263/321/521/748, 40/132/157/243/262/263/521/748, 15/40/132/157/262/263/521/748, 40/102/132/157/262/263/521/748, 40/91/132/157/262/263/521/748, 40/87/132/157/262/263/521/748, 40/85/132/157/262/263/521/748, 20/40/132/157/262/263/521/748, 21/40/132/157/262/263/521/748, or 40/52/132/157/262/263/521/748, wherein the amino acid positions are relative to the reference sequence of SEQ ID NO: 2.

In some embodiments, the recombinant polynucleotide encodes the engineered DNA polymerase polypeptide comprising a substitution or substitution set at amino acid position 40/102/132/157/262/263/476/521/748, 40/102/132/157/262/263/495/521/748, 40/102/132/157/262/263/521/748/750, 21/40/52/102/132/157/262/263/521/748, 21/40/102/132/157/262/263/322/521/748, 20/40/102/132/157/262/263/322/521/748, 20/40/102/132/157/262/263/476/521/748, 40/85/102/132/157/262/263/521/748/750, 40/102/132/157/262/263/386/495/521/748, 40/102/132/157/262/263/476/495/521/748, 40/102/132/157/262/263/322/521/748/820, 40/102/132/157/262/263/386/521/748/849, 20/40/52/85/102/132/157/262/263/521/748, 40/102/132/157/262/263/476/521/748/750, 40/102/132/157/262/263/495/521/748/820, 40/102/132/157/262/263/521/748/750/820, 21/40/52/102/132/157/262/263/521/572/748, 20/40/102/132/157/262/263/322/386/521/748, 21/40/102/132/157/262/263/322/495/521/748, 40/85/102/132/157/262/263/322/476/521/748, 20/40/102/132/157/262/263/386/476/521/748, 21/40/102/132/157/262/263/322/521/748/750, 21/40/102/132/157/262/263/495/521/748/820, 20/40/102/132/157/262/263/495/521/748/820, 40/85/102/132/157/262/263/476/521/748/849, 21/40/102/132/157/262/263/521/748/820/849, 40/102/132/157/262/263/322/386/495/521/748, 40/102/132/157/262/263/273/322/521/748/849, 40/102/

132/157/262/263/476/495/521/748/750, 40/102/132/157/ 262/263/322/521/748/750/820, 40/102/132/157/262/263/ 386/521/748/750/849, 21/40/85/102/132/157/262/263/322/ 521/748/820, 20/40/85/102/132/157/262/263/476/521/748/ 750, 20/40/85/102/132/157/262/263/495/521/748/849, 20/40/85/102/132/157/262/263/521/566/748/820, 40/52/ 102/132/157/262/263/322/498/521/748/750, 21/40/102/ 132/157/262/263/322/386/521/748/820, 40/52/102/132/ 157/262/263/386/495/521/748/820, 20/40/102/132/157/ 262/263/322/476/521/748/820, 40/85/102/132/157/262/ 263/386/495/521/748/750, 40/85/102/132/157/262/263/ 476/495/521/748/820, 40/85/102/132/157/262/263/322/ 521/748/750/820, 40/85/102/132/157/262/263/322/386/ 476/495S/521/748, 21/40/102/132/157/262/263/322/495/ 521/748/750/820, 20/21/40/85/102/132/157/262/263/322/ 476/495/521/748, 20/40/102/132/157/262/263/299/322/ 386/476/495/521/748, 40/52/102/132/157/262/263/476/ 495/521/566/748/750/849, 20/40/85/102/132/157/262/200/ 263/322/476/495S/521/748/750, or 21/40/85/102/132/157/ 262/263/322/386/495/521/748/820/849, wherein the amino acid positions are relative to the reference sequence of SEQ ID NO: 2.

In some embodiments, the recombinant polynucleotide encodes the engineered DNA polymerase polypeptide comprising a substitution or substitution set at amino acid position 40/85/102/132/157/262/263/299/386/521/566/748/ 750/820, 40/85/102/132/157/262/263/476/521/748/750/ 820/849, 21/40/85/102/132/157/262/263/322/476/495/521/ 748/750/820, 40/85/102/132/157/262/177/263/521/748/ 750, 21/40/85/102/132/157/262/263/495/521/748/750, 40/85/102/132/157/262/263/476/521/748/750/820, 20/40/ 52/85/102/132/157/262/263/299/521/748/750, 52/40/85/ 102/132/157/262/263/299/521/748/750, 40/85/102/132/ 157/262/263/322/521/748Y/750S/820, 20/40/85/102/132/ 157/262/263/521/748/750/820, 20/40/85/102/132/157/262/ 263/299/386/476/521/748/750, 40/85/102/132/157/262/ 263/386/476/521/748/750/820, 40/85/102/132/157/262/ 263/476/495/521/748/750/820, 40/85/102/132/157/262/ 263/386/476/495/521/748/750, 20/21/40/85/102/132/157/ 262/263/299/322/386/521/748/750, 40/85/102/132/157/ 262/263/322/386/495/521/748/750, 21/40/85/102/132/157/ 262/263/299/322/476/495/521/748/750/820, 21/40/85/102/ 132/157/262/263/299/386/521/748/750/820, 40/85/102/ 132/157/262/263/299/476/521/748/750/820, 20/21/40/85/ 102/132/157/262/263/521/748/750, 21/40/102/132/157/ 262/263/521/748, 40/85/102/132/157/262/263/521/705/ 748/750, 21/40/85/102/132/157/262/263/386/476/521/748/ 750/820, 40/85/102/132/157/262/263/521/748/750/820, 21/40/85/102/132/157/262/263/299/322/521/748/750, 20/40/85/102/132/157/262/263/322/386/521/748/750/820, 40/85/102/132/157/262/263/299/521/748/750, 21/40/85/ 102/132/157/262/263/299/386/476/521/748/750, 40/85/ 102/109/132/157/262/263/521/748/750, 40/85/102/132/ 157/262/263/322/495/521/748/750, 40/85/102/132/157/ 262/263/491/521/748/750, 40/52/85/102/132/157/262/263/ 521/748/750/820, 21/40/85/102/132/157/262/263/386/521/ 748/750/820, 20/21/40/85/102/132/157/262/263/495/521/ 748/750, 21/40/85/102/132/157/262/263/299/322/495/521/ 566/748/750/820, 20/21/40/85/102/132/157/262/263/299/ 495/521/748/750, 40/85/102/132/157/262/263/521/748/ 750/756, 40/85/102/132/157/262/263/386/521/748/750/ 820, 40/85/102/132/157/262/263/495/521/748/750, 40/85/ 102/132/157/262/263/511/521/748/750, 21/40/52/85/102/ 132/157/262/263/242/386/495/521/748/750/820, 40/85/ 102/132/157/262/263/299/476/495/521/748/750, 40/85/ 102/132/157/262/263/521/706/748/750, 21/40/85/102/132/ 157/262/263/299/386/476/495/521/748/750, 21/40/85/102/ 132/157/262/263/299/322/495/521/748/750, 21/40/85/102/ 132/157/262/263/476/521/748/750/849, 40/85/102/132/ 157/262/263/299/322/476/521/748/750/820, 21/40/52/85/ 102/132/157/262/263/299/322/521/748/750/820, 20/21/40/ 85/102/132/157/262/263/521/566/748/750, 20/40/52/85/ 102/132/157/262/263/521/748/750, 40/85/102/132/157/ 262/263/322/386/495/521/566/748/750/820, 21/40/85/102/ 132/157/262/263/299/521/748/750, 21/40/85/102/132/157/ 262/263/299/386/521/748/750, 40/85/102/132/157/262/ 263/386/521/748/750/849, 40/52/85/102/132/157/262/263/ 476/521/748/750, 40/52/85/102/132/157/262/263/299/322/ 386/495/521/748/750, or 40/85/102/132/157/262/263/440/ 521/748/750, wherein the amino acid positions are relative to the reference sequence of SEQ ID NO: 2.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606, wherein the polypeptide sequence comprises one or more substitutions relative to the reference sequence corresponding to residues 12 to 850 of SEQ ID NO: 8, 332, 462, or 606, or to the reference sequence corresponding to SEQ ID NO: 8, 332, 462, or 606.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, 332, 462, or 606, or to a reference sequence corresponding to SEQ ID NO: 8, 332, 462, or 606, wherein the polypeptide sequence comprises one or more substitutions relative to the reference sequence corresponding to residues 12 to 850 of SEQ ID NO: 8, 332, 462, or 606, or to the reference sequence corresponding to SEQ ID NO: 8, 332, 462, or 606, with the proviso that the polypeptide sequence does not comprise the sequence comprising residues 12 to 850 of SEQ ID NO:2.

In some embodiments, the recombinant polynucleotide encodes the engineered DNA polymerase comprising a polypeptide sequence comprising at least a substitution at amino acid position 15, 16, 20, 21, 22, 40, 41, 52, 57, 58, 73, 85, 87, 88, 91, 102, 109, 132, 157, 177, 186, 200, 213, 217, 231, 232, 242, 243, 262, 263, 264, 265, 273, 299, 321, 322, 328, 384, 386, 401, 402, 403, 404, 406, 407, 440, 476, 480, 491, 495, 498, 503, 504, 506, 507, 508, 511, 514, 520, 521, 523, 524, 525, 526, 527, 528, 529, 530, 533, 534, 535, 536, 537, 538, 539, 540, 542, 553, 554, 555, 556, 557, 558, 559, 560, 562, 563, 566, 570, 572, 581, 582, 584, 585, 586, 587, 589, 592, 593, 594, 595, 596, 597, 599, 601, 602, 603, 605, 607, 616, 665, 671, 674, 675, 677, 684, 688, 696, 704, 705, 706, 728, 735, 747, 748, 749, 750, 751, 753, 755, 756, 762, 763, 764, 766, 772, 773, 779, 793, 803, 814, 820, or 849, or combinations thereof, wherein the amino acid positions are relative to the reference sequence of SEQ ID NO: 8, 332, 462, or 606.

In some embodiments, the recombinant polynucleotide encodes the engineered DNA polymerase comprising a polypeptide sequence comprising at least a substitution at amino acid position 40, 85, 102, 132, 157, 177, 262, 263, 521, 748, or 750, or combinations thereof.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 8, or to a reference sequence corresponding to SEQ ID NO: 8, wherein the polypeptide sequence comprises one or more substitutions relative to the reference sequence corresponding to residues 12 to 850 of SEQ ID NO: 8, or to the reference sequence corresponding to SEQ ID NO: 8.

In some embodiments, the recombinant polynucleotide encodes the engineered DNA polymerase comprising a polypeptide sequence comprising at least a substitution or substitution set at amino acid position 22/407, 328, 401, 402, 403, 404, 406, 407, 503, 504, 506, 521, 523, 524, 525, 526, 527, 528, 529, 530, 531, 533, 534, 535, 536, 537, 538, 539, 540, 542, 553, 554, 555, 556, 557, 558, 559, 560, 563, 581, 582, 585, 586, 587, 589, 592, 592, 592, 593, 594, 595, 596, 597, 598, 599, 601, 602, 603, 605, 607, 696, 747, 749, 751, 762, 763, 764, 766, 773, 803, or 403/553, wherein the amino acid positions are relative to the reference sequence of SEQ ID NO: 8.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 332, or to a reference sequence corresponding to SEQ ID NO: 332, wherein the polypeptide sequence comprises one or more substitutions relative to the reference sequence corresponding to residues 12 to 850 of SEQ ID NO: 332, or to the reference sequence corresponding to SEQ ID NO: 332.

In some embodiments, the recombinant polynucleotide encodes the engineered DNA polymerase comprising a polypeptide sequence comprising at least a substitution or substitution set at amino acid position 15, 20, 21, 52, 85, 87, 91, 102, 243, 321, 322, 384, 404, 476, 480, 480, 495, 542, 570, 671, 675, 704, 728, 735, 753, 755, 762, 764, 793, 820, 16/735, 750/849, 524/581, 403/404/524/542/555/762/764, 404/524/542/589/762/764, 524/542/581/762/764, or 542/762/764, wherein the amino acid positions are relative to the reference sequence of SEQ ID NO: 332.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 462, or to a reference sequence corresponding to SEQ ID NO: 462, wherein the polypeptide sequence comprises one or more substitutions relative to the reference sequence corresponding to residues 12 to 850 of SEQ ID NO: 462, or to the reference sequence corresponding to SEQ ID NO: 462.

In some embodiments, the recombinant polynucleotide encodes the engineered DNA polymerase comprising a polypeptide sequence comprising at least a substitution or substitution set at amino acid position 750/820, 21/52, 20/21/85/322/476/495, 20/85/200/322/476/495/750, 476/750, 20/476, 20/322/386, 85/322/476, 52/322/498/750, 20/322/476/820, 85/476/495/820, 21/85/322/820, 20/299/322/386/476/495/820, 20/322, 21/820/849, 476, 322/820, 21/322/386/820, 322/386/495, 85/386/495/750, 20/85/476/750, 20/386/476, 85/322/386/476/495, 20/495/820, 750, 21/322/495, 52/386/495/820, 21/322, 85/322/750/820, 20/52/85, 21/52/572, 20/85/495/849, 85/750, 21/495/820, 273/322/849, 495, 322/750/820, 52/476/495/566/750/849, 386/495, 495/820, 21/322/495/750/820, 21/85/322/386/495/820/849, 476/495/750, 386/849, 476/495, 85/476/849, 21/322/750, 20/85/566/820, or 386/750/849, wherein the amino acid positions are relative to the reference sequence of SEQ ID NO: 462.

In some embodiments, the recombinant polynucleotide encodes the engineered DNA polymerase comprising a polypeptide sequence having at least 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to residues 12 to 850 of SEQ ID NO: 606, or to a reference sequence corresponding to SEQ ID NO: 606, wherein the polypeptide sequence comprises one or more substitutions relative to the reference sequence corresponding to residues 12 to 850 of SEQ ID NO: 606, or to the reference sequence corresponding to SEQ ID NO: 606.

the recombinant polynucleotide encodes an engineered DNA polymerase comprising a polypeptide sequence comprising at least a substitution or substitution set at amino acid position 299/386/566/820, 476/820/849, 21/322/476/495/820, 177, 21/495, 476/820, 20/52/299, 52/299, 322/820, 20/820, 20/299/386/476, 386/476/820, 476/495/820, 386/476/495, 20/21/299/322/386, 322/386/495, 21/299/322/476/495/820, 21/299/386/820, 299/476/820, 20/21, 21/85/102/750, 705, 21/386/476/820, 820, 21/299/322, 20/21/322/386/820, 299, 21/299/386/476, 109, 322/495, 491, 52/820, 21/386/820, 20/21/495, 21/299/322/495/566/820, 20/21/299/495, 756, 386/820, 495, 511, 21/52/242/386/495/820, 299/476/495, 706, 21/299/386/476/495, 21/299/322/495, 21/476/849, 299/322/476/820, 21/52/299/322/820, 20/21/566, 20/52, 322/386/495/566/820, 21/299, 21/299/386, 386/849, 52/476, 52/299/322/386/495, 440, or combinations thereof, wherein the amino acid positions are relative to the reference sequence of SEQ ID NO: 606.

In some embodiments, for each of the foregoing embodiments, the specific amino acid substitutions described herein for the substitution or substitution set can be used for the encoded engineered DNA polymerase polypeptide.

In some embodiments, the recombinant polynucleotide encodes an engineered DNA polymerase comprising a polypeptide sequence comprising at least a substitution in at least one amino acid position provided in Table 4.1, 5.1, 6.1, 7.1, and 8.1, wherein the substitution is relative to SEQ ID NO: 2, 8, 332, 462, or 606.

In some embodiments, the recombinant polynucleotide encodes an engineered DNA polymerase comprising a polypeptide sequence comprising at least one substitution provided in Table 4.1, 5.1, 6.1, 7.1, and 8.1, wherein the substitution is relative to SEQ ID NO: 2, 8, 332, 462, or 606.

In some embodiments, the recombinant polynucleotide encodes an engineered DNA polymerase comprising at least a substitution or substitution set provided for each variant in Table 4.1, 5.1, 6.1, 7.1, and 8.1, wherein the substitution or substitution set is relative to SEQ ID NO: 2, 8, 332, 462, or 606.

In some embodiments, the recombinant polynucleotide encodes an engineered DNA polymerase comprising a polypeptide sequence having at least 75%, 80%, 85%, 86%, 887%, 88%, 89%, 90%, 91%, 92%, 93%, 94%, 95%, 96%, 97%, 98%, 99% or more sequence identity to a sequence comprising residues 12 to 850 of an even numbered SEQ ID NO. set forth in Table 4.1, 5.1, 6.1, 7.1, and 8.1. In some embodiments, the recombinant polynucleotide encodes an engineered DNA polymerase comprising a polypeptide sequence comprising at least 75%, 80%, 85%, 86%, 887%, 88%, 89%, 90%, 91%, 92%, 93%, 94%, 95%, 96%, 97%, 98%, 99% or more sequence identity to a sequence of an even numbered SEQ ID NO. set forth in Table 4.1, 5.1, 6.1, 7.1, and 8.1. In some embodiments, the recombinant polynucleotide encodes an engineered DNA polymerase comprising a polypeptide sequence comprising residues 12 to 850 of an even numbered SEQ ID NO. set forth in Table 4.1, 5.1, 6.1, 7.1, and 8.1. In some embodiments, the recombinant polynucleotide encodes an engineered DNA polymerase comprising a polypeptide sequence comprising an even numbered SEQ ID NO. set forth in Table 4.1, 5.1, 6.1, 7.1, and 8.1.

In some embodiments, the recombinant polynucleotide encodes an engineered DNA polymerase comprising a polypeptide sequence comprising residues 12 to 850 of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, or 770, or a fragment thereof, wherein the polypeptide sequence has optionally 1, 2, 3, 4, 5, 6, 7, 8, 9, or up to 10 substitutions in the polypeptide sequence.

In some embodiments, the encoded engineered DNA polymerase polypeptide includes 1, 2, 3, 4, up to 5 substitutions in the polypeptide sequence. In some embodiments, the encoded engineered DNA polymerase polypeptide includes 1, 2, 3, or 4 substitutions in the polypeptide sequence. In some embodiments, the substitutions comprises non-conservative or conservative substitutions. In some embodiments, the substitutions comprises conservative substitutions. In some embodiments, the substitutions comprises non-conservative substitutions. In some embodiments, guidance on non-conservative and conservative substitutions are provided by the variants disclosed herein.

In some embodiments, the recombinant polynucleotide encodes an engineered DNA polymerase polypeptide comprising a polypeptide sequence comprising residues 12 to 850 of SEQ ID NO: 8, 332, 462, or 606, or a polypeptide sequence comprising SEQ ID NO: 8, 332, 462, or 606, wherein the polypeptide sequence has optionally 1, 2, 3, 4, 5, 6, 7, 8, 9, or up to 10 substitutions in the polypeptide sequence. In some embodiments, the encoded DNA polymerase includes 1, 2, 3, 4, up to 5 substitutions in the polypeptide sequence. In some embodiments, the encoded DNA polymerase includes 1, 2, 3, or 4 substitutions in the polypeptide sequence.

In some embodiments, the recombinant polynucleotide comprises a polynucleotide sequence having at least 75%, 80%, 81%, 82%, 83%, 84%, 85%, 90%, 91%, 92%, 93%, 94%, 95%, 96%, 97%, 98%, 99%, or more sequence identity to a reference polynucleotide sequence comprising nucleotide residues 34 to 2550 of SEQ ID NO: 1, or to a reference polynucleotide sequence of SEQ ID NO: 1, wherein the recombinant polynucleotide encodes an engineered DNA polymerase or a functional fragment thereof, wherein the polypeptide sequence of the engineered DNA polymerase comprises one or more substitutions at one or more amino acid positions relative to the reference sequence comprising residues 12 to 850 of SEQ ID NO:2, or to the reference sequence of SEQ ID NO: 2.

In some embodiments, the recombinant polynucleotide comprises a polynucleotide sequence having at least 75%, 80%, 81%, 82%, 83%, 84%, 85%, 90%, 91%, 92%, 93%, 94%, 95%, 96%, 97%, 98%, 99%, or more sequence identity to a reference polynucleotide sequence comprising nucleotide residues 34 to 2550 of SEQ ID NO: 7, 331, 461, or 605, or to a reference polynucleotide sequence of SEQ ID NO: 7, 331, 461, or 605, wherein the recombinant polynucleotide encodes an engineered DNA polymerase or a functional fragment thereof.

In some embodiments, the recombinant polynucleotide comprises a polynucleotide sequence having at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a polynucleotide sequence corresponding to nucleotide residues 34 to 2550 of SEQ ID NO: 3, 5, 7, 9, 11, 13, 15, 17, 19, 21, 23, 25, 27, 29, 31, 33, 35, 37. 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 656, 655, 657, 659, 661, 663, 665. 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, or 769, wherein the polynucleotide encodes an engineered DNA polymerase, as described herein.

In some embodiments, the recombinant polynucleotide comprises a polynucleotide sequence comprising nucleotide residues 34 to 2550 of SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 656, 655, 657, 659, 661, 663, 665. 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, or 769.

In some embodiments, the recombinant polynucleotide comprises a polynucleotide sequence having at least 75%, 80%, 85%, 86%, 87%, 88%, 89%, 90%, 91%, 92%, 93%, 94%, 95%, 96%, 97%, 98%, 99% or more sequence identity to a polynucleotide sequence corresponding to SEQ ID NO: 3, 5, 7, 9, 11, 13, 15, 17, 19, 21, 23, 25, 27, 29, 31, 33, 35, 37. 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 656, 655, 657, 659, 661, 663, 665. 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, or 769, wherein the recombinant polynucleotide encodes an engineered DNA polymerase, as described herein.

In some embodiments, the recombinant polynucleotide comprises the sequence comprising SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 656, 655, 657, 659, 661, 663, 665. 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, or 769.

In some embodiments, the recombinant polynucleotide encodes a DNA polymerase and hybridizes under highly stringent conditions to a reference polynucleotide sequence described herein encoding an engineered DNA polymerase. In some embodiments, the reference sequence corresponds to residues residues 34 to 2550 of SEQ ID NO: 1, 7, 331, 461, or 605, or to the sequence corresponding to SEQ ID NO: 1, 7, 331, 461, or 605, or a complement thereof, or a polynucleotide sequence encoding any of the other engineered DNA polymerases provided herein. In some embodiments, the polynucleotide encodes a DNA polymerase and hybridizes under highly stringent conditions to a reference polynucleotide comprising a sequence corresponding to residues 34 to 2550 of an odd numbered seqeunce of SEQ ID NOS: 1-769, or to a reference polynucleotide comprising a sequence corresponding to an odd numbered sequence of SEQ ID NOS: 1-769.

In some embodiments, the polynucleotide capable of hybridizing under highly stringent conditions encodes a DNA polymerase comprising an amino acid sequence that has one or more residue differences as compared to SEQ ID NO: 2, 8, 332, 462, or 606, at residue positions selected from any positions as set forth in Tables 4.1, 5.1, 6.1, 7.1, and 8.1. In some embodiments, the polynucleotide that hybridizes under highly stringent conditions comprises a polynucleotide having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to residues 34 to 2550 of SEQ ID NO: 1, 7, 331, 461, or 605, or to a reference sequence corresponding to SEQ ID NO: 1, 7, 331, 461, or 605. In some additional embodiments, the polynucleotide hybridizing under highly stringent conditions comprises a sequence having at least 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide reference sequence corresponding to residues 34 to 2550 of a polynucleotide sequence provided in Tables 4.1, 5.1, 6.1, 7.1, and 8.1, or corresponding to a polynucleotide sequence provided in Tables 4.1, 5.1, 6.1, 7.1, and 8.1.

In some embodiments, an isolated polynucleotide encoding any of the engineered DNA polymerase polypeptides herein is manipulated in a variety of ways to facilitate expression of the DNA polymerase polypeptide. In some embodiments, the polynucleotides encoding the DNA polymerase polypeptides comprise expression vectors where one or more control sequences is present to regulate the expression of the DNA polymerase polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art.

In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic betalactamase gene (See e.g., Villa-Kamaroff et al., Proc. Natl Acad. Sci. USA, 1978, 75:3727-3731), as well as the tac promoter (See e.g., DeBoer et al., Proc. Natl Acad. Sci. USA, 1983, 80:21-25). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (see, e.g., Romanos et al., Yeast, 1992, 8:423-488).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the DNA polymerase polypeptide. Any suitable terminator which is functional in the host cell of choice finds use in the present invention. For bacterial expression, the transcription terminators can be a Rho-dependent terminators that rely on a Rho transcription factor, or a Rho-independent, or intrinsic terminators, which do not require a transcription factor. Exemplary bacterial transcription terminators are described in Peters et al., J Mol Biol., 2011, 412(5):793-813. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the DNA polymerase polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Biol., 1995, 15:5983-5990).

In some embodiments, the control sequence comprises a 3' untranslated nucleic acid region and polyadenylation tail nucleic acid sequence, sequences operably linked to the 3' terminus of the protein coding nucleic acid sequence which mediate binding to proteins involved in mRNA trafficking and translation and mRNA half-life. Any polyadenylation sequence and 3' UTR which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase.

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NC1B 11837 maltogenic amylase, *Bacillus stearothermophilus* alpha-amylase, *Bacillus licheniformis* subtilisin, *Bacillus licheniformis* betalactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 1993, 57:109-137). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present disclosure provides a recombinant expression vector comprising a polynucleotide encoding an engineered DNA polymerase polypeptide, and one or more expression regulating regions such as a promoter and a terminator, a replication origin, etc., depending on the type of hosts into which they are to be introduced. In some embodiments, the various nucleic acid and control sequences described herein are joined together (i.e., operably linked) to produce recombinant expression vectors which include one or more convenient restriction sites to allow for insertion or substitution of the nucleic acid sequence encoding the DNA polymerase polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the DNA polymerase polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or A. orzyae), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or A. orzyae), sC (sulfate adenyltransferase), and trpC (anthranilate synthase), as well as equivalents thereof.

In another aspect, the present invention provides a host cell comprising at least one polynucleotide encoding at least one engineered DNA polymerase polypeptide of the present invention, the polynucleotide(s) being operatively linked to one or more control sequences for expression of the engineered DNA polymerase enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21).

Accordingly, in another aspect, the present disclosure provides methods of producing the engineered DNA polymerase polypeptides, where the methods comprise culturing a host cell capable of expressing a polynucleotide encoding the engineered DNA polymerase polypeptide under conditions suitable for expression of the polypeptide. In some embodiments, the methods further comprise the step(s) of isolating and/or purifying the DNA polymerase polypeptides, as described herein. In some embodiments, the host cell is a bacterial cell, such as *E. coli*. or *B. subtilis*.

Appropriate culture media and growth conditions for host cells are well known in the art. It is contemplated that any suitable method for introducing polynucleotides for expression of the DNA polymerase polypeptides into cells will find use in the present invention. Suitable techniques include, but are not limited to electroporation, biolistic particle bombardment, liposome mediated transfection, calcium chloride transfection, and protoplast fusion.

Engineered DNA polymerase polypeptides with the properties disclosed herein can be obtained by subjecting the polynucleotide encoding the naturally occurring or engineered DNA polymerase polypeptide to any suitable mutagenesis and/or directed evolution methods known in the art, and/or as described herein. An exemplary directed evolution technique is mutagenesis and/or DNA shuffling (See e.g., Stemmer, Proc. Natl. Acad. Sci. USA, 1994, 91:10747-10751; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (see e.g., Zhao et al., Nat. Biotechnol., 1998, 16:258-261), mutagenic PCR (See e.g., Caldwell et al., PCR Methods Appl., 1994, 3:S136-S140), and cassette mutagenesis (See e.g., Black et al., Proc. Natl. Acad. Sci. USA, 1996, 93:3525-3529).

For example, mutagenesis and directed evolution methods can be readily applied to DNA polymerase-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837, 458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related PCT and non-US counterparts; Ling et al., Anal. Biochem., 1997, 254(2):157-78; Dale et al., Meth. Mol. Biol., 1996, 57:369-74; Smith, Ann. Rev. Genet., 1985, 19:423-462; Botstein et al., Science, 1985, 229:1193-1201; Carter, Biochem. J., 1986, 237:1-7; Kramer et al., Cell, 1984, 38:879-887; Wells et al., Gene, 1985, 34:315-323; Minshull et al., Curr. Op. Chem. Biol., 1999, 3:284-290; Christians et al., Nat. Biotechnol., 1999, 17:259-264; Crameri et al., Nature, 1998, 391:288-291; Crameri, et al., Nat. Biotechnol., 1997, 15:436-438; Zhang et al., Proc. Nat. Acad. Sci. U.S.A., 1997, 94:4504-4509; Crameri et al., Nat. Biotechnol., 1996, 14:315-319; Stemmer, Nature, 1994, 370:389-391; Stemmer, Proc. Nat. Acad. Sci. USA, 1994, 91:10747-10751; EP 3 049 973; WO 95/22625; WO 97/0078; WO 97/35966; WO 98/27230; WO 00/42651; WO 01/75767; WO 2009/152336; and WO 2015/048573, all of which are incorporated herein by reference).

In some embodiments, the protein variants obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a DNA polymerase polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tet. Lett., 1981, 22:1859-69; and Matthes et al., EMBO J., 1984, 3:801-05), as it is typically practiced in automated synthetic methods. According to the phosphoramidite method, oligonucleotides are synthesized (e.g., in an automatic DNA synthesizer, purified, annealed, ligated and cloned in appropriate vectors).

Accordingly, in some embodiments, a method for preparing the engineered DNA polymerase polypeptide can comprise: (a) synthesizing a polynucleotide encoding a polypeptide comprising an amino acid sequence selected from the amino acid sequence of any variant as described herein, and (b) expressing the DNA polymerase polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions are conservative or non-conservative substitutions.

The expressed engineered DNA polymerase polypeptide can be evaluated for any desired improved property or combination of properties (e.g., activity, selectivity, fidelity, stability, thermostability, tolerance to various pH levels, protease sensitivity, etc.) using any suitable assay known in the art, including but not limited to the assays and conditions described herein.

In some embodiments, any of the engineered DNA polymerase polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the DNA polymerase polypeptides include, among others, reverse phase chromatography, high-performance liquid chromatography, ion-exchange chromatography, hydrophobic-interaction chromatography, size-exclusion chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved DNA polymerase enzymes. For affinity chromatography purification, any antibody that specifically binds a DNA polymerase polypeptide of interest may find use. For the production of antibodies, various host animals, including but not limited to rabbits, mice, rats, etc., are immunized by injection with a DNA polymerase polypeptide, or a fragment thereof. In some embodiments, the DNA polymerase polypeptide or fragment is attached to a suitable carrier, such as BSA, by means of a side chain functional group or linkers attached to a side chain functional group.

In some embodiments, the isolated or purified engineered DNA polymerase polypeptides are combined with other ingredients and compounds to provide compositions and formulations comprising the engineered DNA polymerase polypeptide as appropriate for different applications and uses (e.g., diagnostic methods and compositions). In some embodiments, a composition comprises at least one engineered DNA polymerase of the present disclosure. In some embodiments, the composition further comprises a buffer. In some embodiments, the composition further comprises a substrate, such as nucleotide substrates (e.g., dNTPs, dNTP analogs, and/or modified dNTPs) and/or at least one primer, e.g., complementary to a target nucleic acid. In some embodiments, the composition further comprises a target DNA template.

In some embodiments, the composition can further comprise a DNA polymerase (e.g., a second DNA polymerase) other than the engineered DNA polymerase. In some embodiments, the second DNA polymerase is a second thermostable DNA polymerase, for example Taq or Pfu polymerase, or a reverse transcriptase, such as those useful in RT-PCR coupled reactions. In some embodiments, the composition includes a probe or indicator, such as a nucleic acid binding dye (e.g., SYBR® Green), for detecting and/or quantitating the amount of product formed, e.g., in a qRT-PCR reaction.

Uses of Engineered DNA Polymerase Polypeptides and Kits

In another aspect, the present disclosure provides uses of the engineered DNA polymerases for diagnostic and molecular biological purposes, such as for detecting the presence of a target nucleic acid and direct/indirect sequencing of nucleic acids.

In some embodiments, the engineered DNA polymerase is used in preparing a complementary DNA of a target DNA. In some embodiments, a method of preparing a complementary DNA of a target DNA comprises contact a target DNA with an engineered DNA polymerase described herein in presence of substrates sufficient for producing a complementary DNA under reaction conditions suitable for production of a complementary DNA to all or a portion (i.e., whole or in part) of the target DNA. As discussed herein and known in the art, substrates include nucleotides (e.g., dNTPs) for DNA polymerase activity and/or oligonucleotide primers. Primers can be to a specific sequence of the target nucleic acid, or random primers, such as for generation of DNA libraries.

In some embodiments, the target DNA is any DNA appropriate as a template for the engineered DNA polymerase, including, but not limited to, genomic DNA, mitochondrial DNA, cell-free DNA (e.g., obtained from blood/serum), bacterial DNA, fungal DNA, or viral DNA.

In some embodiments, the engineered DNA polymerase is useful in diagnostic applications, e.g., for detecting the presence of a target nucleic acid, including RNA and DNA. In some embodiments, a method for detecting presence of a target DNA comprises reacting a sample suspected of containing a target DNA with an engineered DNA polymerase described herein in presence of substrates under conditions suitable for DNA polymerase mediated production of a DNA complementary to all or a portion (i.e., whole or in part) of the target DNA, and detecting the presence of the complementary DNA. In some embodiments, a target RNA can be detected by using a reverse transcriptase to produce a corresponding target DNA complementary to the target RNA.

In some embodiments, the sample can be any material or substance suspected of containing a target nucleic acid. In some embodiments, the sample is a biological sample, such as biopsy and autopsy samples, frozen sections taken for histological purposes, blood, plasma, serum, sputum, stool, tears, mucus, hair, skin, etc. In some embodiments, the biological sample are cells or viruses, such as from a bacterial culture, virus culture, or cell culture. In some embodiments, the sample is an environmental sample, such as from water, sewage, surfaces, air, filtrates, etc.

In some embodiments for detecting a target DNA, the detection of the complementary DNA product can be effectuated by known methods in the art. In some embodiments, the complementary DNA is detected by amplifying the complementary DNA, such as by polymerase chain reaction (PCR) or isothermal amplification. In some embodiments, a suitable isothermal amplification is by loop mediated isothermal amplification (LAMP). In some embodiments for detecting the presence of a target RNA, the reaction with a reverse transcriptase is conducted separately from the amplification reaction with the DNA polymerase. In some embodiments, where the amplification is by PCR, the reverse transcriptase reaction and the PCR is a one-step RT-PCR (i.e., performed in a single reaction simultaneously). In some embodiments, where the amplification is by PCR, the reverse transcriptase reaction and the PCR is a two-step RT-PCR (i.e., performed separately).

In some embodiments, the engineered DNA polymerase is used for sequencing nucleic acids. Various methods for sequencing DNA, particularly NGS sequencing methods, are well known in the art.

In a further aspect, the present disclosure provides a kit comprising at least one engineered DNA polymerase disclosed herein. In some embodiments, the kit further comprises one or more of a buffer, a nucleotide substrate, and/or an oligonucleotide primer. In some embodiments, the kit can include multiple (e.g., two or more) oligonucleotide primers, for example to different portions of a target nucleic acid. In some embodiments, the kit further comprises a template DNA or target DNA. In some embodiments, the kit comprises a second DNA polymerase, such as Taq or Pfu DNA polymerase or reverse transcriptase, e.g., for coupled RT-PCR reaction.

EXAMPLES

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); Ω (ohm); μf (microfarad); U (units); MW (molecular weight); rpm (rotations per minute); rcf (relative centrifugal force); psi and PSI (pounds per square inch); ° C. (degrees Centigrade); RT and rt (room temperature); NGS (next-generation sequencing); ds (double stranded); ss (single stranded); CDS (coding sequence); DNA (deoxyribonucleic acid); RNA (ribonucleic acid); *E. coli* W3110 (commonly used laboratory *E. coli* strain, available from the *Coli* Genetic Stock Center [CGSC], New Haven, CT); HTP (high throughput); HPLC (high pressure liquid chromatography); MCYP (microcyp); ddH2O (double distilled water); PBS (phosphate buffered saline); BSA (bovine serum albumin); DTT (dithiothreitol); CAM (chloramphenicol); CAT (chloramphenicol acetyltransferase); IPTG (isopropyl β-D-1-thiogalactopyranoside); GFP (green fluorescent protein); eGFP (enhanced GFP); DsRed (red fluorescent protein isolated from Discosoma sp.); FIOPC (fold improvements over positive control); LB (Luria-Bertani); SPRI (solid phase reversible immobilization); Sigma-Aldrich (Sigma-Aldrich, St. Louis, MO); Perkin Elmer (Perkin Elmer, Inc, Waltham, MA); Harvard Apparatus (Harvard Apparatus, Holliston, MA); Millipore (Millipore, Corp., Billerica MA); Covaris (Covaris, Inc., Woburn, MA); MagBio (MagBio Genomics, Inc., Gaithersburg, MD); Qiagen (Qiagen Inc., Germantown, MD); Illumina (Illumina, Inc., San Diego, CA); BD Biosciences (BD Biosciences, San Jose, CA); Difco (Difco Laboratories, BD Diagnostic Systems, Detroit, MI); Kuhner (Adolf Kuhner, AG, Basel, Switzerland); Zymo (Zymo Research, Irvine, CA); Agilent (Agilent Technologies, Inc., Santa Clara, CA); Thermo Scientific (part of Thermo Fisher Scientific, Waltham, MA); GE Healthcare (GE Healthcare Bio-Sciences, Piscataway, NJ); and Bio-Rad (Bio-Rad Laboratories, Hercules, CA).

Example 1: *E. coli* Expression Hosts Containing Recombinant Polymerase Genes

The initial polymerase enzyme used to produce the variants of the present disclosure was SEQ ID NO: 2 cloned into the expression vector pCK110900 (see, FIG. 3 of US Pat. Appln. Publn. No. 2006/0195947) operatively linked to the lac promoter under control of the lacI repressor. The expression vector also contains the P15a origin of replication and the chloramphenicol resistance gene. The resulting plasmids were transformed into *E. coli* W3110, using standard methods known in the art. The transformants were isolated by subjecting the cells to chloramphenicol selection, as known in the art (see e.g., U.S. Pat. No. 8,383,346 and WO2010/144103).

Example 2: Preparation of HTP Polymerase-Containing Wet Cell Pellets

E. coli cells containing recombinant polymerase-encoding genes from monoclonal colonies were inoculated into 180 µl LB containing 1% glucose and 30 µg/mL chloramphenicol (CAM) in the wells of 96-well, shallow-well microtiter plates. The plates were sealed with 02-permeable seals, and cultures were grown overnight at 30° C., 200 rpm, and 85% humidity. Then, 10 µl of each of the cell cultures were transferred into the wells of 96-well, deep-well plates containing 390 mL TB and 30 µg/mL CAM. The deep-well plates were sealed with 02-permeable seals and incubated at 30° C., 250 rpm, and 85% humidity until OD600 0.6-0.8 was reached. The cell cultures were then induced by IPTG to a final concentration of 1 mM and incubated overnight under the same conditions as originally used. The cells were then pelleted using centrifugation at 4,000 rpm for 10 min. The supernatants were discarded, and the pellets were frozen at −80° C. prior to lysis.

Example 3: Preparation of HTP Polymerase-Containing Cell Lysates

First, 300 µl buffer containing 50 mM Tris-HCl pH 7.5 and 20 mM sodium chloride, were added to the cell paste in each well, produced as described in Example 2. The cells were shaken on a bench top shaker to resuspend. Resuspended cells were transferred to a 96 well Hard shell plate and lysed at 80° C. for 60 min. in a thermocycler. The plate was then centrifuged for 30 min at 4,000 rpm and 40° C. The clear supernatants were used in biocatalytic reactions to determine their activity, DNA sensitivity and thermostability levels.

Example 4: Improvements Over SEQ ID NO: 2 in PCR Amplification Activity

SEQ ID NO: 2 was selected as the parent enzyme after screening wild type enzymes polymerase activity in a PCR assay using beta-lactam fragment in pCK vector (pCK-betalactamase) with primers SeqF1 (CCAATACGCAAACCGCCTC) (SEQ ID NO: 771) and SeqR1 (CAACGGTGGTATATCCAGTGA) (SEQ ID NO: 772). Libraries of engineered genes were produced using well established techniques (e.g., saturation mutagenesis, recombination of previously identified beneficial mutations). The polypeptides encoded by each gene were produced in HTP as described in Example 2, and the soluble lysate was generated as described in Example 3. Each variant was screened in a 20 µL reaction that comprised 5 ng/uL pCK-betalactamase, 500 nM SeqF1 and SeqR1 primers, 0.2 mMv dNTPs, Pfu Buffer (20 mMv Tris-HCl (pH 8.8 at 25° C.), 10 mM $(NH_4)_2SO_4$, 10 mM KCl, 0.1% (v/v) Triton X-100, 0.1 mg/mL BSA.), 5 vol % HTP lysate. PCR cycling was performed (95° C. 2 min, 95° C. 30 sec, 55° C. 30 sec, 68° C. 1 min, for 30 cycles) in an Eppendorf Master *Nexus* Thermal Cycler.

Activity relative to SEQ ID NO: 2 (Activity Fold Improvement Over Parent, FIOP) was calculated as the Product Conc. (ng/ul) Relative to SEQ ID NO: 2 and shown in Table 4.1.

TABLE 4.1

Positive Control FIOP Product Conc. (ng/ul) Relative to SEQ ID NO: 2

| SEQ ID NO: (nt/aa) | Amino Acid Differences (Relative to SEQ ID NO:2) | Pos Control FIOP Product Conc. (ng/ul) Relative to SEQ ID NO: 2 |
|---|---|---|
| 1/2 | Wild type (w/His-tag) | + |
| 3/4 | R213P/L503I/Q508H/H584N/H748Y | +++ |
| 5/6 | S40A/V132Y/H748Y | +++ |
| 7/8 | S40A/V132Y/S157G/I262L/S263A/H748Y | +++ |
| 9/10 | V132Y | +++ |
| 11/12 | S40A/V132Y/L503I/H748Y | +++ |
| 13/14 | S40A/V132Y/S157G/L503I/G562S | +++ |
| 15/16 | S40A/V132Y/R213P/H748Y/R814E | +++ |
| 17/18 | V132Y/S157G/G562S/H584N | +++ |
| 19/20 | V132Y/H584N/H748Y | +++ |
| 21/22 | S40A/V132Y/D231E/I684V/H748Y | +++ |
| 23/24 | S40A/V132Y | +++ |
| 25/26 | S40A/Y41F/V132Y/G562S/I684V/H748Y | +++ |
| 27/28 | Y41F/R213P/D231E/L503I/I650A/D674T/H748Y | +++ |
| 29/30 | V132Y/D231E/L503I/H748Y | +++ |
| 31/32 | S40A/V132Y/S157G/L503I | +++ |
| 33/34 | L503I/H748Y/R814E | +++ |
| 35/36 | S40A/V132Y/D231E/L503I/D674T/H748Y | +++ |
| 37/38 | S40A/S88T/V132Y/L503I/I684V/H748Y | +++ |
| 39/40 | V132Y/S157G/R213P/D674T/H748Y/R814E | +++ |
| 41/42 | S157G/S263A/H748Y | +++ |
| 43/44 | S40A/H748Y | +++ |
| 45/46 | Y41F/S157G/D231E/I262L/H748Y/R814E | +++ |
| 47/48 | S40A/R213P/L503I/G562S/H584N/H748Y | +++ |
| 49/50 | R523K/R524K | +++ |
| 51/52 | S40A/V132Y/L503I/Y514F/I650A/D674T | ++ |
| 53/54 | S40A/V132Y/S157G/R213P/D231E | ++ |
| 55/56 | Y41F/R213P/A520P/R814E | ++ |
| 57/58 | S40A/Y41F/S157G/D231E/L503I | ++ |
| 59/60 | S40A/S157G/L503I | ++ |
| 61/62 | S40A/V132Y/G562S/H748Y | ++ |
| 63/64 | V132Y/H748Y | ++ |
| 65/66 | S40A/Y41F/V132Y/G562S/H748Y | ++ |
| 67/68 | S88T/R213P/L503I/H584N/I684V/H748Y | ++ |
| 69/70 | V57T/H58N/R523K/G616A/R677M | ++ |
| 71/72 | S40A/R213P/D231E/L503I/Y514F/G562S/H748Y | ++ |
| 73/74 | V132Y/G562S | ++ |
| 75/76 | R213P/L503I/I650A | ++ |
| 77/78 | S40A/Y41F/S88T/D231E/H748Y/R814E | ++ |
| 79/80 | Y41F/R213P/I262L/G562S | ++ |
| 81/82 | Y41F/S88T/D231E/H748Y | ++ |
| 83/84 | R213P/S263A/H748Y | ++ |
| 85/86 | S40A/S157G/R213P | ++ |
| 87/88 | S157G/A520P | ++ |
| 89/90 | S40A/V132Y/S263A/L503I/D674T/R814E | ++ |
| 91/92 | S40A/Y41F | ++ |
| 93/94 | R524K/M665V/A756N | ++ |
| 95/96 | H58N/Q186E/A217E/R523K/R524K/R677M | ++ |
| 97/98 | S40A/Y41F/H748Y | + |
| 99/100 | V132Y/Y514F | + |
| 101/102 | A520P | + |
| 103/104 | Y41F/R213P/L503I/G562S | + |
| 105/106 | D231E/L503I/H748Y/V772I | + |
| 107/108 | L503I/G562S | + |

TABLE 4.1-continued

Positive Control FIOP Product Conc. (ng/ul) Relative to SEQ ID NO: 2

| SEQ ID NO: (nt/aa) | Amino Acid Differences (Relative to SEQ ID NO:2) | Pos Control FIOP Product Conc. (ng/ul) Relative to SEQ ID NO: 2 |
|---|---|---|
| 109/110 | E73A/R232C/Y514F/H584N/R814E | + |
| 111/112 | H58N/D507K/G616A | + |
| 113/114 | V132Y/I262L/A520P/G562S/I684V/H748Y | + |
| 115/116 | S88T/G562S/R814E | + |
| 117/118 | Y41F/S88T/S157G/R814E | + |
| 119/120 | S88T/S157G/R213P/D674T/I684V | + |
| 121/122 | V57T/H58N/R523K/L779I | + |
| 123/124 | S40A/V132Y/S157G/Y514F/A520P/I684V | + |
| 125/126 | S40A/Y41F/R213P/I684V/V772I | + |
| 127/128 | S40A/Y41F/D231E/L503I/R814E | + |
| 129/130 | S88T/R213P/L503I/H584N/R814E | + |
| 131/132 | S40A/Y41F/V132Y/G562S/H584N | + |
| 133/134 | Y41F/S88T/R213P/D231E/L503I/I650A/H748Y | + |
| 135/136 | S40A/L503I | + |
| 137/138 | S40A/V132Y/R213P/D231E/A520P/G562S/I650A/R814E | + |
| 139/140 | S40A/Y41F/V132Y/D231E/I262L/L503I/G562S/H584N/H748Y/R814E | + |
| 141/142 | V57T/H58N/R264T/M265I/R524K/V688I | + |
| 143/144 | S88T/V132Y/S157G/I262L/S263A/A520P/G562S | + |
| 145/146 | S88T/V132Y/S157G/I262L/L503I/Y514F/G562S/I650A | + |
| 147/148 | S40A/H584N/D674T/H748Y | + |
| 149/150 | S40A/Y41F/V132Y/S263A/L503I | + |
| 151/152 | H584N/H748Y | + |
| 153/154 | S40A/R213P/D674T | + |
| 155/156 | S40A/Y41F/S88T/V132Y/L503I/G562S/H584N/H748Y | + |
| 157/158 | S88T/R213P/Y514F/G562S/H748Y/R814E | + |
| 159/160 | S263A/A520P/R814E | + |
| 161/162 | S40A/Y41F/S88T/S157G | + |

Levels of increased activity were determined relative to the reference polypeptide of SEQ ID NO: 2, and defined as follows:
"+" > than 1-fold but less than 2-fold increased activity;
"++" > than 2-fold but less than 3-fold increased activity;
"+++" > than 3-fold increased activity.

Example 5: Improvements Over SEQ ID NO: 8 in qPCR Enzyme Activity

DNA polymerase variant SEQ ID NO: 8 was selected as the parent enzyme for this round of directed evolution. Libraries of engineered genes were produced using well established techniques (e.g., saturation mutagenesis, recombination of previously identified beneficial mutations). The polypeptides encoded by each gene were produced in HTP as described in Example 2, and the soluble lysate was generated as described in Example 3. Each variant was screened in a 20 μL reaction that comprised 1 ng/uL SARS-CoV2 DNA fragment (IDT Catalog #>CAT_10006625_2019-nCoV_N_Positive Control), containing the nucleocapsid gene, 500 nM N1 primers, 125 nM probe (CDC EUA assay, Catalog #2019-nCoVEUA-01), 0.2 mM dNTPs, RT buffer (10 mM Tris-HCl, 50 mM KCl, 1.5 mM $MgCl_2$), 12.5 vol % HTP lysate, and qPCR cycling (95° C. 2 min, 95° C. 3 sec, 55° C. 30 sec for 45 cycles) in a CFX384 Touch Real-Time PCR detection System (BioRad).

Increased activity relative to the reference polypeptide of SEQ ID NO: 8 (Activity FIOP) was calculated as the inverse of Ct value (critical threshold) formed by the variant compared to Ct value of SEQ ID NO: 8 and shown in Table 5.1.

TABLE 5.1

Positive Control FIOP Increase Activity (Activity FIOP 1/Cq) Relative to SEQ ID NO: 8

| SEQ ID NO: (nt/aa) | Amino Acid Differences (Relative to SEQ ID NO: 8) | Amino Acid Differences (Relative to SEQ ID NO: 2) | Pos Control FIOP (Activity FIOP 1/Cq) Relative to SEQ ID NO: 8 |
|---|---|---|---|
| 163/164 | N599S | S40A/V132Y/S157G/I262L/S263A/N599S/H748Y | ++ |
| 165/166 | K530G | S40A/V132Y/S157G/I262L/S263A/K530G/H748Y | ++ |
| 167/168 | S596L | S40A/V132Y/S157G/I262L/S263A/S596L/H748Y | ++ |
| 169/170 | R696H | S40A/V132Y/S157G/I262L/S263A/R696H/H748Y | ++ |
| 171/172 | R542W | S40A/V132Y/S157G/I262L/S263A/R542W/H748Y | ++ |
| 173/174 | K530R | S40A/V132Y/S157G/I262L/S263A/K530R/H748Y | ++ |
| 175/176 | Q553F | S40A/V132Y/S157G/I262L/S263A/Q553F/H748Y | ++ |
| 177/178 | T533V | S40A/V132Y/S157G/I262L/S263A/T533V/H748Y | ++ |
| 179/180 | R555M | S40A/V132Y/S157G/I262L/S263A/R555M/H748Y | ++ |
| 181/182 | S594V | S40A/V132Y/S157G/I262L/S263A/S594V/H748Y | ++ |
| 183/184 | S594W | S40A/V132Y/S157G/I262L/S263A/S594W/H748Y | ++ |

TABLE 5.1-continued

Positive Control FIOP Increase Activity (Activity FIOP 1/Cq) Relative to SEQ ID NO: 8

| SEQ ID NO: (nt/aa) | Amino Acid Differences (Relative to SEQ ID NO: 8) | Amino Acid Differences (Relative to SEQ ID NO: 2) | Pos Control FIOP (Activity FIOP 1/Cq) Relative to SEQ ID NO: 8 |

TABLE 5.1-continued

Positive Control FIOP Increase Activity (Activity FIOP 1/Cq) Relative to SEQ ID NO: 8

| SEQ ID NO: (nt/aa) | Amino Acid Differences (Relative to SEQ ID NO: 8) | Amino Acid Differences (Relative to SEQ ID NO: 2) | Pos Control FIOP (Activity FIOP 1/Cq) Relative to SEQ ID NO: 8 |
|---|---|---|---|
| 257/258 | V749R | S40A/V132Y/S157G/I262L/S263A/H748Y/V749R | ++ |
| 259/260 | V766Y | S40A/V132Y/S157G/I262L/S263A/H748Y/V766Y | ++ |
| 261/262 | E556P | S40A/V132Y/S157G/I262L/S263A/E556P/H748Y | ++ |
| 263/264 | S595P | S40A/V132Y/S157G/I262L/S263A/S595P/H748Y | ++ |
| 265/266 | T533Q | S40A/V132Y/S157G/I262L/S263A/T533Q/H748Y | ++ |
| 267/268 | I603V | S40A/V132Y/S157G/I262L/S263A/I603V/H748Y | ++ |
| 269/270 | V537G | S40A/V132Y/S157G/I262L/S263A/V537G/H748Y | ++ |
| 271/272 | A589W | S40A/V132Y/S157G/I262L/S263A/A589W/H748Y | ++ |
| 273/274 | P598W | S40A/V132Y/S157G/I262L/S263A/P598W/H748Y | ++ |
| 275/276 | Q22K/S407R | Q22K/S40A/V132Y/S157G/I262L/S263A/S407R/H748Y | ++ |
| 277/278 | R555W | S40A/V132Y/S157G/I262L/S263A/R555W/H748Y | ++ |
| 279/280 | E539R | S40A/V132Y/S157G/I262L/S263A/E539R/H748Y | ++ |
| 281/282 | R531Q | S40A/V132Y/S157G/I262L/S263A/R531Q/H748Y | ++ |
| 283/284 | T581A | S40A/V132Y/S157G/I262L/S263A/T581A/H748Y | ++ |
| 285/286 | H803R | S40A/V132Y/S157G/I262L/S263A/H748Y/H803R | ++ |
| 287/288 | L538A | S40A/V132Y/S157G/I262L/S263A/L538A/H748Y |

TABLE 5.1-continued

Positive Control FIOP Increase Activity (Activity FIOP 1/Cq) Relative to SEQ ID NO: 8

| SEQ ID NO: (nt/aa) | Amino Acid Differences (Relative to SEQ ID NO: 8) | Amino Acid Differences (Relative to SEQ ID NO: 2) | Pos Control FIOP (Activity FIOP 1/Cq) Relative to SEQ ID NO: 8

TABLE 5.1-continued

Positive Control FIOP Increase Activity (Activity FIOP 1/Cq) Relative to SEQ ID NO: 8

| SEQ ID NO: (nt/aa) | Amino Acid Differences (Relative to SEQ ID NO: 8) | Amino Acid Differences (Relative to SEQ ID NO: 2) | Pos Control FIOP (Activity FIOP 1/Cq) Relative to SEQ ID NO: 8 |
|---|---|---|---|
| 401/402 | N599G | S40A/V132Y/S157G/I262L/S263A/N599G/H748Y | + |
| 403/404 | V537W | S40A/V132Y/S157G/I262L/S263A/V537W/H748Y | + |
| 405/406 | H803C | S40A/V132Y/S157G/I262L/S263A/H748Y/H803C | + |
| 407/408 | E556F | S40A/V132Y/S157G/I262L/S263A/E556F/H748Y | + |
| 409/410 | L557G | S40A/V132Y/S157G/I262L/S263A/L557G/H748Y | + |
| 411/412 | Q601M | S40A/V132Y/S157G/I262L/S263A/Q601M/H748Y | + |
| 413/414 | S596R | S40A/V132Y/S157G/I262L/S263A/S596R/H748Y | + |
| 415/416 | T563L | S40A/V132Y/S157G/I262L/S263A/T563L/H748Y | + |
| 417/418 | Q601P | S40A/V132Y/S157G/I262L/S263A/Q601P/H748Y | + |

Control), containing the transcript of the nucleocapsid gene, 500 nM N1 primers, 125 nM probe (CDC EUA assay, Catalog #2019-nCoVEUA-01), 0.2 MMv dNTPs, RT buffer (10 mM Tris-HCl, 50 mMV KCl, 1.5 mM MgCl₂), 6 vol % HTP lysate. qPCR was performed by incubating at 62.5° C. for 30 min followed by cycling (95° C. 2 min, 95° C. 3 sec, 55° C. 30 sec for 45 cycles) in a CFX384 Touch Real-Time PCR detection System (BioRad).

Enzyme activity relative to SEQ ID NO: 332 (Activity FIOP) was calculated as the inverse of Ct value (critical threshold) formed by the variant over the inverse of Ct value of SEQ ID NO: 332 and shown in Table 6.1.

TABLE 6.1

| | Pos Control FIOP 1/Cq Relative to SEQ ID NO: 332 | | |
|---|---|---|---|
| SEQ ID NO: (nt/aa) | Amino Acid Differences (Relative to SEQ ID NO: 332) | Amino Acid Differences (Relative to SEQ ID NO: 2) | Pos Control FIOP (Activity FIOP 1/Cq) Relative to SEQ ID NO: 332 |
| 437/438 | Q404S/R542G/A762M | S40A/V132Y/S57G/I262L/ S263A/Q404S/A521G/ R542G/H748Y/A762M | ++ |
| 439/440 | R524Q/R542G/ T581A/A762M/E764V | S40A/V132Y/S157G/I262L/ S263A/A521G/R524Q/R542G/ T581A/H748Y/A762M/E764V | ++ |
| 441/442 | Q404S/R524Q/R542G/ A589L/A762M/E764V | S40A/V132Y/S157G/I262L/ S263A/Q404S/A521G/R524Q/ R542G/A589L/H748Y/A762M/E764V | ++ |
| 443/444 | E764V | S40A/V132Y/157G/I262L/ S263A/A521G/H748Y/E764V | ++ |
| 445/446 | N403R/Q404S/R524Q/ R542G/R555H/A762M/E764V | S40A/V132Y/S157G/I262L/ S263A/N403R/Q404S/A521G/R524Q/ R542G/R555H/H748Y/A762M/E764V | ++ |
| 447/448 | L476N | S40A/V132Y/S157G/I262L/ S263A/L476N/A521G/H748Y | ++ |
| 449/450 | R542G/A762M/E764V | S40A/V132Y/S157G/I262L/S263A/ A521G/R542G/H748Y/A762M/E764V | ++ |
| 451/452 | R728K | S40A/V132Y/S157G/I262L/ S263A/A521G/H748Y/R728K | + |
| 453/454 | S52R | S40A/S52R/V132Y/S157G/ I262L/S263A/A521G/H748Y | + |
| 455/456 | L476I | S40A/V132Y/S157G/I262L/ S263A/L476I/A521G/H748Y | + |
| 457/458 | P675L | S40A/V132Y/S157G/I262L/ S263A/A521G/P675L/H748Y | + |
| 459/460 | P750S/A849T | S40A/V132Y/S157G/I262L/ S263A/A521G/H748Y/P750S/A849T | + |
| 461/462 | V102S/ | S40A/V102S/V132Y/S157G/ I262L/S263A/A521G/H748Y | + |
| 463/464 | F21C/ | F21C/S40A/V132Y/S157G/ I262L/S263A/A521G/H748Y | + |
| 465/466 | K755P/ | S40A/V132Y/S157G/I262L/ S263A/A521G/H748Y/K755P | + |
| 467/468 | F21S/ | F21S/S40A/V132Y/S157G/ I262L/S263A/A521G/H748Y | + |
| 469/470 | E321G/ | S40A/V132Y/S157G/I262L/ S263A/E321G/A521G/H748Y | + |
| 471/472 | L20A | L20A/S40A/V132Y/S157G/ I262L/S263A/A521G/H748Y | + |
| 473/474 | F21K | F21K/S40A/V132Y/S157G/ I262L/S263A/A521G/H748Y | + |
| 475/476 | P87N | S40A/P87N/V132Y/S157G/ I262L/S263A/A521G/H748Y | + |
| 477/478 | L20C/ | L20C/S40A/V132Y/S157G/ I262L/S263A/A521G/H748Y | + |
| 479/480 | Q16R/E735L | Q16R/S40A/V132Y/S157G/ I262L/S263A/A521G/E735L/H748Y | + |
| 481

TABLE 6.1-continued

Pos Control FIOP 1/Cq Relative to SEQ ID NO: 332

| SEQ ID NO: (nt/aa) | Amino Acid Differences (Relative to SEQ ID NO: 332) | Amino Acid Differences (Relative to SEQ ID NO: 2) | Pos Control FIOP (Activity FIOP 1/Cq) Relative to SEQ ID NO: 332 |
|---|---|---|---|
| 497/498 | R322N | S40A/V132Y/S157G/I262L/S263A/R322N/A521G/H748Y | + |
| 499/500 | K570R | S40A/V132Y/S157G/I262L/S263A/A521G/K570R/H748Y | + |
| 501/502 | Q480V | S40A/V132Y/S157G/I262L/S263A/Q480V/A521G/H748Y | + |
| 503/504 | L753V | S40A/V132Y/S157G/I262L/S263A/A521G/H748Y/L753V | + |
| 505/506 | L753K | S40A/V132Y/S157G/I262L/S263A/A521G/H748Y/L753K | + |
| 507/508 | R524Q/T581A | S40A/V132Y/S157G/I262L/S263A/A521G/R524Q/T581A/H748Y | + |
| 509/510 | H91K | S40A/H91K/V132Y/S157G/I262L/S263A/A521G/H748Y | + |
| 511/512 | P243L | S40A/V132Y/S157G/P243L/I262L/S263A/A521G/H748Y | + |
| 513/514 | P243S | S40A/V132Y/S157G/P243S/I262L/S263A/A521G/H748Y | + |
| 515/516 | V671E | S40A/V132Y/S157G/I262L/S263A/A521G/V671E/H748Y | + |
| 517/518 | P85S | S40A/P85S/V132Y/S157G/I262L/S263A/A521G/H748Y | + |
| 519/520 | R495M | S40A/V132Y/S157G/I262L/S263A/R495M/A521G/H748Y | + |
| 521/522 | V15A | V15A/S40A/V132Y/S157G/I262L/S263A/A521G/H748Y | + |
| 523/524 | V15N | V15N/S40A/V132Y/S157G/I262L/S263A/A521G/H748Y | + |
| 525/526 | V15K | V15K/S40A/V132Y/S157G/I262L/S263A/A521G/H748Y | + |
| 527/528 | R820A | S40A/V132Y/S157G/I262L/S263A/A521G/H748Y/R820A | + |
| 529/530 | R495E | S40A/V132Y/S157G/I262L/S263A/A521G/H748Y/R495E | + |
| 531/532 | P85E | S40A/P85E/V132Y/S157G/I262L/S263A/A521G/H748Y | + |
| 533/534 | P85R | S40A/P85R/V132Y/S157G/I262L/S263A/A521G/H748Y | + |
| 535/536 | Q480E | S40A/V132Y/S157G/I262L/S263A/Q480E/A521G/H748Y | + |
| 537/538 | V15G | V15G/S40A/V132Y/S157G/I262L/S263A/A521G/H748Y | + |
| 539/540 | V671R | S40A/V132Y/S157G/I262L/S263A/A521G/V671R/H748Y | + |

Levels of increased activity were determined relative to the reference polypeptide of SEQ ID NO: 332, and defined as follows:
"+" > than 1-fold but less than 3-fold increased activity;
"++" > than 3-fold increased activity.

Example 7: Improvements Over SEQ ID NO: 462 in Stability and Activity

DNA polymerase variant SEQ ID NO: 462 was selected as the parent enzyme for this round of directed evolution. Libraries of engineered genes were produced using well established techniques (e.g., saturation mutagenesis, recombination of previously identified beneficial mutations). The polypeptides encoded by each gene were produced in HTP as described in Example 2, and the soluble lysate was generated as described in Example 3. Each variant was screened in a 20 μL reaction that comprised of 0.2 ng/uL SARS-CoV2 DNA fragment, (IDT Catalog #>CAT_10006625_2019-nCoV_N_Positive Control), containing the transcript of the nucleocapsid gene, 500 nM N1 primers, 125 nM probe (CDC EUA assay, Catalog #2019-nCoVEUA-01), 0.2 mM dNTPs, RT buffer (10 mM Tris-HCl, 50 mM KCl, 1.5 mM $MgCl_2$), 6 vol % HTP lysate, and qPCR performed by incubation at 62.5° C. for 30 min followed by qPCR cycling (95° C. 2 min, 95° C. 3 sec, 55° C. 30 sec for 45 cycles) in a CFX384 Touch Real-Time PCR detection System (BioRad).

Polymerase stability and activity relative to SEQ ID NO: 462 (Processivity FIOP) was calculated as the inverse of Ct value (critical threshold) formed by the variant over the inverse of Ct value of SEQ ID NO: 462 and shown in Table 7.1.

TABLE 7.1

| SEQ ID NO: (nt/aa) | Amino Acid Differences (Relative to SEQ ID NO: 462) | Amino Acid Differences (Relative to SEQ ID NO: 2) | Pos Control FIOP (Activity FIOP 1/Cq) Relative to SEQ ID NO: 462 |
|---|---|---|---|
| 541/542 | P750S/R820A | S40A/V102S/V132Y/S157G/I262L/ S263A/A521G/H748Y/P750S/R820A | ++ |
| 543/544 | F21C/S52R | F21C/S40A/S52R/V102S/V132Y/ S157G/I262L/S263A/A521G/H748Y | ++ |
| 545/546 | L20C/F21C/P85E/ R322N/L476N/R495E | L20C/F21C/S40A/P85E/V102S/ V132Y/S157G/I262L/S263A/ R322N/L476N/R495E/A521G/H748Y | ++ |
| 547/548 | L20C/P85E/A200V/ R322N/L476N/R495S/P750S | L20C/S40A/P85E/V102S/V132Y/ S157G/I262L/A200V/S263A/R322N/ L476N/R495S/A521G/H748Y/P750S | ++ |
| 549/550 | L476N/P750S | S40A/V102S/V132Y/S157G/I262L/ S263A/L476N/A521G/H748Y/P750S | ++ |
| 551/552 | L20C/L476N | L20C/S40A/V102S/V132Y/S157G/ I262L/S263A/L476N/A521G/H748Y | ++ |
| 553/554 | L20C/R322N/R386V | L20C/S40A/V102S/V132Y/ S157G/I262L/S263A/ R322N/R386V/A521G/H748Y | ++ |
| 555/556 | P85E/R322N/L476N | S40A/P85E/V102S/V132Y/ S157G/I262L/S263A/ R322N/L476N/A521G/H748Y | ++ |
| 557/558 | S52R/R322N/G498D/P750S | S40A/S52R/V102S/V132Y/ S157G/I262L/S263A/R322N/ G498D/A521G/H748Y/P750S | ++ |
| 559/560 | L20C/R322N/L476N/R820A | L20C/S40A/V102S/V132Y/ S157G/I262L/S263A/R322N/ L476N/A521G/H748Y/R820A | ++ |
| 561/562 | P85E/L476N/R495E/R820A | S40A/P85E/V102S/V132Y/ S157G/I262L/S263A/L476N/ R495E/A521G/H748Y/R820A | ++ |
| 563/564 | F21C/P85E/R322N/R820A | F21C/S40A/P85E/V102S/ V132Y/S157G/I262L/S263A/ R322N/A521G/H748Y/R820A | ++ |
| 565/566 | L20C/T299N/R322N/ R386V/L476N/R495E/R820A | L20C/S40A/V102S/V132Y/ S157G/I262L/S263A/T299N/R322N/ R386V/L476N/R495E/A521G/H748Y | ++ |
| 567/568 | L20C/R322N | L20C/S40A/V102S/V132Y/ S157G/I262L/S263A/ R322N/A521G/H748Y | ++ |
| 569/570 | F21C/R820A/A849T | F21C/S40A/V102S/V132Y/ S157G/I262L/S263A/ A521G/H748Y/R820A/A849T | ++ |
| 571/572 | L476N | S40A/V102S/V132Y/S157G/ I262L/S263A/L476N/A521G/H748Y | ++ |
| 573/574 | R322N/R820A | S40A/V102S/V132Y/S157G/ I262L/S263A/R322N/ A521G/H748Y/R820A | ++ |
| 575/576 | F21C/R322N/R386V/R820A | F21C/S40A/V102S/V132Y/ S157G/I262L/S263A/R322N/ R386V/A521G/H748Y/R820A | ++ |
| 577/578 | R322N/R386V/R495E | S40A/V102S/V132Y/S157G/ I262L/S263A/R322N/ R386V/R495E/A521G/H748Y | ++ |
| 579/580 | P85E/R386V/R495E/P750S | S40A/P85E/V102S/V132Y/ S157G/I262L/S263A/R386V/ R495E/A521G/H748Y/P750S | ++ |
| 581/582 | L20C/P85E/L476N/P750S | L20C/S40A/P85E/V102S/ V132Y/S157G/I262L/S263A/ L476N/A521G/H748Y/P750S | ++ |
| 583/584 | L20C/R386V/L476N | L20C/S40A/V102S/ V132Y/S157G/I262L/S263A/ R386V/L476N/A521G/H748Y | ++ |
| 585/586 | P85E/R322N/ R386V/L476N/R495S | S40A/P85E/V102S/V132Y/ S157G/I262L/S263A/R322N/ R386V/L476N/R495S/A521G/H748Y | ++ |
| 587/588 | L20C/R495E/R820A | L20C/S40A/V102S/V132Y/ S157G/I262L/S263A/ R495E/A521G/H748Y/R820A | ++ |
| 589/590 | P750S | S40A/V102S/V132Y/S157G/ I262L/S263A/A521G/H748Y/P750S | ++ |
| 591/592 | F21C/R322N/R495E | F21C/S40A/V102S/V132Y/ S157G/I262L/S263A/ R322N/R495E/A521G/H748Y | ++ |

TABLE 7.1-continued

Pos Control FIOP 1/Cq Relative to SEQ ID NO: 462

| SEQ ID NO: (nt/aa) | Amino Acid Differences (Relative to SEQ ID NO: 462) | Amino Acid Differences (Relative to SEQ ID NO: 2) | Pos Control FIOP (Activity FIOP 1/Cq) Relative to SEQ ID NO: 462 |
|---|---|---|---|
| 593/594 | S52R/R386V/R495S/R820A | S40A/S52R/V102S/V132Y/ S157G/I262L/S263A/R386V/ R495S/A521G/H748Y/R820A | ++ |
| 595/596 | F21C/R322N | F21C/S40A/V102S/V132Y/ S157G/I262L/S263A/ R322N/A521G/H748Y | ++ |
| 597/598 | P85E/R322N/P750S/R820A | S40A/P85E/V102S/V132Y/ S157G/I262L/S263A/R322N/ A521G/H748Y/P750S/R820A | ++ |
| 599/600 | L20C/S52R/P85E | L20C/S40A/S52R/P85E/ V102S/V132Y/S157G/ I262L/S263A/A521G/H748Y | ++ |
| 601/602 | F21C/S52R/V572I | F21C/S40A/S52R/V102S/ V132Y/S157G/I262L/ S263A/A521G/V572I/H748Y | ++ |
| 603/604 | L20C/P85E/R495E/A849T | L20C/S40A/P85E/V102S/ V132Y/S157G/I262L/S263A/ R495E/A521G/H748Y/A849T | ++ |
| 605/606 | P85E/P750S | S40A/P85E/V102S/ V132Y/S157G/I262L/ S263A/A521G/H748Y/P750S | ++ |
| 607/608 | F21C/R495E/R820A | F21C/S40A/V102S/V132Y/ S157G/I262L/S263A/ R495E/A521G/H748Y/R820A | ++ |
| 609/610 | V273M/R322N/A849T | S40A/V102S/V132Y/ S157G/I262L/S263A/V273M/ R322N/A521G/H748Y/A849T | ++ |
| 611/612 | R495E | S40A/V102S/V132Y/ S157G/I262L/S263A/ R495E/A521G/H748Y | ++ |
| 613/614 | R322N/P750S/R820A | S40A/V102S/V132Y/ S157G/I262L/S263A/R322N/ A521G/H748Y/P750S/R820A | + |
| 615/616 | S52R/L476N/R495E/ D566A/P750S/A849T | S40A/S52R/V102S/V132Y/ S157G/I262L/S263A/L476N/R495E/ A521G/D566A/H748Y/P750S/A849T | + |
| 617/618 | R386V/R495E | S40A/V102S/V132Y/S157G/I262L/ S263A/R386V/R495E/A521G/H748Y | + |
| 619/620 | R495S/R820A | S40A/V102S/V132Y/S157G/I262L/ S263A/R495S/A521G/H748Y/R820A | + |
| 621/622 | F21C/R322N/ R495E/P750S/R820A | F21C/S40A/V102S/V132Y/ S157G/I262L/S263A/R322N/ R495E/A521G/H748Y/P750S/R820A | + |
| 623/624 | F21C/P85E/ R322N/R386V/ R495S/R820A/A849T | F21C/S40A/P85E/V102S/V132Y/ S157G/I262L/S263A/R322N/ R386V/R495S/A521G/H748Y/R820A/A849T | + |
| 625/626 | R495S | S40A/V102S/V132Y/ S157G/I262L/S263A/ R495S/A521G/H748Y | + |
| 627/628 | L476N/R495E/P750S | S40A/V102S/V132Y/ S157G/I262L/S263A/L476N/ R495E/A521G/H748Y/P750S | + |
| 629/630 | R386V/A849T | S40A/V102S/V132Y/ S157G/I262L/S263A/ R386V/A521G/H748Y/A849T | + |
| 631/632 | L476N/R495E | S40A/V102S/V132Y/ S157G/I262L/S263A/ L476N/R495E/A521G/H748Y | + |
| 633/634 | P85E/L476N/A849T | S40A/P85E/V102S/ V132Y/S157G/I262L/S263A/ L476N/A521G/H748Y/A849T | + |
| 635/636 | F21C/R322N/P750S | F21C/S40A/V102S/V132Y/ S157G/I262L/S263A/ R322N/A521G/H748Y/P750S | + |

TABLE 7.1-continued

| | Pos Control FIOP 1/Cq Relative to SEQ ID NO: 462 | | |
|---|---|---|---|
| SEQ ID NO: (nt/aa) | Amino Acid Differences (Relative to SEQ ID NO: 462) | Amino Acid Differences (Relative to SEQ ID NO: 2) | Pos Control FIOP (Activity FIOP 1/Cq) Relative to SEQ ID NO: 462 |
| 637/638 | L20C/P85E/ D566A/R820A | L20C/S40A/P85E/V102S/ V132Y/S157G/I262L/S263A/ A521G/D566A/H748Y/R820A | + |
| 639/640 | R386V/P750S/A849T | S40A/V102S/V132Y/ S157G/I262L/S263A/R386V/ A521G/H748Y/P750S/A849T | + |

Levels of increased activity were determined relative to the reference polypeptide of SEQ ID NO: 462, and defined as follows:
"+" > than 1-fold but less than 2-fold increased activity;
"++" > than 2-fold increased activity.

Example 8: Improvements Over SEQ ID NO: 606 in Activity and Sensitivity

SEQ ID NO: 606 was selected as the parent enzyme for this round of directed evolution. Libraries of engineered genes were produced using well established techniques (e.g., saturation mutagenesis, recombination of previously identified beneficial mutations). The polypeptides encoded by each gene were produced in HTP as described in Example 2, and the soluble lysate was generated as described in Example 3. Each variant was screened in a 20 µL reaction that comprised of 0.125 ng/uL SARS-CoV2 DNA fragment, (IDT Catalog #>CAT_10006625_2019-nCoV_N_Positive Control), containing the nucleocapsid gene, 500 nM N1 primers, 125 nM probe (CDC EUA assay, Catalog #2019-nCoVEUA-01), 0.2 mM dNTPs, RT buffer (10 mM Tris-HCl, 50 mM KCl, 1.5 mM $MgCl_2$), 1.5 vol % HTP lysate, and qPCR performed by incubating at 62.5° C. for 30 min followed by qPCR cycling (95° C. 2 min, 95° C. 3 sec, 55° C. 30 sec for 45 cycles) in a CFX384 Touch Real-Time PCR detection System (BioRad).

Polymerase stability and activity relative to SEQ ID NO: 606 (Processivity FIOP) was calculated as the inverse of Ct value (critical threshold) formed by the variant over the inverse of Ct value of SEQ ID NO: 606 and shown in Table 8.1.

TABLE 8.1

| Pos Control FIOP 1/Cq Relative to SEQ ID NO: 606 | | | |
|---|---|---|---|
| SEQ ID NO: (nt/aa) | Amino Acid Differences (Relative to SEQ ID NO: 606) | Amino Acid Differences (Relative to SEQ ID NO: 2) | Pos Control FIOP (Activity FIOP 1/Cq) Relative to SEQ ID NO: 606 |
| 641/642 | T299N/R386V/D566A/R820A | S40A/P85E/V102S/V132Y/S157G/I262L/S263A/299N/R386V/TA521G/D566A/H748Y/P750S/R820A | ++ |
| 643/644 | L476N/R820A/A849T | S40A/P85E/V102S/V132Y/S157G/I262L/S263A/L476N/A521G/H748Y/P750S/R820A/A849T | ++ |
| 645/646 | F21C/R322N/L476N/R495E/R820A | F21C/S40A/P85E/V102S/V132Y/S157G/I262L/S263A/R322N/L476N/R495E/A521G/H748Y/P750S/R820A | ++ |
| 647/648 | R177T | S40A/P85E/V102S/V132Y/S157G/I262L/R177T/S263A/A521G/H748Y/P750S | ++ |
| 649/650 | F21C/R495E | F21C/S40A/P85E/V102S/V132Y/S157G/I262L/S263A/R495E/A521G/H748Y/P750S | ++ |
| 651/652 | L476N/R820A | S40A/P85E/V102S/V132Y/S157G/I262L/S263A/L476N/A521G/H748Y/P750S/R820A | ++ |
| 653/654 | L20C/S52R/T299N | L20C/S40A/S52R/P85E/V102S/V132Y/S157G/I262L/S263A/T299N/A521G/H748Y/P750S | ++ |
| 655/656 | S52R/T299N | S52R/S40A/P85E/V102S/V132Y/S157G/I262L/S263A/T299N/A521G/H748Y/P750S | ++ |
| 657/658 | R322N/R820A | S40A/P85E/V102S/V132Y/S157G/I262L/S263A/R322N/A521G/H748Y/P750S/R820A | ++ |
| 659/660 | L20C/R820A | L20C/S40A/P85E/V102S/V132Y/S157G/I262L/S263A/A521G/H748Y/P750S/R820A | ++ |
| 661/662 | L20C/T299N/R386V/L476N | L20C/S40A/P85E/V102S/V132Y/S157G/I262L/S263A/T299N/R386V/L476N/A521G/H748Y/P750S | ++ |

TABLE 8.1-continued Pos Control FIOP 1/Cq Relative to SEQ ID NO: 606

| SEQ ID NO: (nt/aa) | Amino Acid Differences (Relative to SEQ ID NO: 606) | Amino Acid Differences (Relative to SEQ ID NO: 2) | Pos Control FIOP (Activity FIOP 1/Cq) Relative to SEQ ID NO: 606 |
|---|---|---|---|
| 663/664 | R386V/L476N/R820A | S40A/P85E/V102S/V132Y/ S157G/I262L/S263A/R386V/ L476N/A521G/H748Y/P750S/R820A | ++ |
| 665/666 | L476N/R495E/R820A | S40A/P85E/V102S/V132Y/ S157G/I262L/S263A/L476N/ R495E/A521G/H748Y/P750S/R820A | ++ |
| 667/668 | R386V/L476N/R495E | S40A/P85E/V102S/V132Y/ S157G/I262L/S263A/R386V/ L476N/R495E/A521G/H748Y/P750S | ++ |
| 669/670 | L20C/F21C/T299N/R322N/R386V | L20C/F21C/S40A/P85E/V102S/ V132Y/S157G/I262L/S263A/ T299N/R322N/R386V/A521G/H748Y/P750S | ++ |
| 671/672 | R322N/R386V/R495E | S40A/P85E/V102S/V132Y/ S157G/I262L/S263A/R322N/ R386V/R495E/A521G/H748Y/P750S | ++ |
| 673/674 | F21C/T299N/R322N/ L476N/R495E/R820A | F21C/S40A/P85E/V102S/V132Y/ S157G/I262L/S263A/T299N/R322N/ L476N/R495E/A521G/H748Y/P750S/R820A | + |
| 675/676 | F21C/T299N/R386V/R820A | F21C/S40A/P85E/V102S/ V132Y/S157G/I262L/S263A/T299N/ R386V/A521G/H748Y/P750S/R820A | + |
| 677/678 | T299N/L476N/R820A | S40A/P85E/V102S/V132Y/ S157G/I262L/S263A/T299N/ L476N/A521G/H748Y/P750S/R820A | + |
| 679/680 | L20C/F21C | L20C/F21C/S40A/P85E/ V102S/V132Y/S157G/I262L/ S263A/A521G/H748Y/P750S | + |
| 681/682 | F21C/E85P/S102V/S750P | F21C/S40A/V102S/ V132Y/S157G/I262L/ S263A/A521G/H748Y | + |
| 683/684 | Y705W | S40A/P85E/V102S/V132Y/ S157G/I262L/S263A/A521G/ Y705W/H748Y/P750S | + |
| 685/686 | F21C/R386V/L476N/R820A | F21C/S40A/P85E/V102S/ V132Y/S157G/I262L/S263A/R386V/ L476N/A521G/H748Y/P750S/R820A | + |
| 687/688 | R820A | S40A/P85E/V102S/ V132Y/S157G/I262L/S263A/ A521G/H748Y/P750S/R820A | + |
| 689/690 | F21C/T299N/R322N | F21C/S40A/P85E/V102S/ V132Y/S157G/I262L/S263A/ T299N/R322N/A521G/H748Y/P750S | + |
| 691/692 | L20C/F21C/R322N/R386V/R820A | L20C/S40A/P85E/V102S/ V132Y/S157G/I262L/S263A/R322N/ R386V/A521G/H748Y/P750S/R820A | + |
| 693/694 | T299N | S40A/P85E/V102S/ V132Y/S157G/I262L/S263A/ T299N/A521G/H748Y/P750S | + |
| 695/696 | F21C/T299N/R386V/L476N | F21C/S40A/P85E/V102S/ V132Y/S157G/I262L/S263A/T299N/ R386V/L476N/A521G/H748Y/P750S | + |
| 697/698 | K109P | S40A/P85E/V102S/ K109P/V132Y/S157G/I262L/ S263A/A521G/H748Y/P750S | + |
| 699/700 | R322N/R495E | S40A/P85E/V102S/V132Y/ S157G/I262L/S263A/R322N/ R495E/A521G/H748Y/P750S | + |
| 701/702 | A491G | S40A/P85E/V102S/V132Y/ S157G/I262L/S263A/ A491G/A521G/H748Y/P750S | + |
| 703/704 | S52R/R820A | S40A/S52R/P85E/V102S/ V132Y/S157G/I262L/S263A/ A521G/H748Y/P750S/R820A | + |
| 705/706 | F21C/R386V/R820A | F21C/S40A/P85E/V102S/ V132Y/S157G/I262L/S263A/ R386V/A521G/H748Y/P750S/R820A | + |
| 707/708 | L20C/F21C/R495E | L20C/F21C/S40A/P85E/V102S/ V132Y/S157G/I262L/S263A/ R495E/A521G/H748Y/P750S | + |
| 709/710 | F21C/T299N/R322N/ R495E/D566A/R820A | F21C/S40A/P85E/V102S/V132Y/ S157G/I262L/S263A/T299N/R322N/ R495E/A521G/D566A/H748Y/P750S/R820A | + |

TABLE 8.1-continued

| SEQ ID NO: (nt/aa) | Amino Acid Differences (Relative to SEQ ID NO: 606) | Amino Acid Differences (Relative to SEQ ID NO: 2) | Pos Control FIOP (Activity FIOP 1/Cq) Relative to SEQ ID NO: 606 |
|---|---|---|---|
| 711/712 | L20C/F21C/T299N/R495E | L20C/F21C/S40A/P85E/V102S/ V132Y/S157G/I262L/S263A/ T299N/R495E/A521G/H748Y/P750S | + |
| 713/714 | A756T | S40A/P85E/V102S/V132Y/ S157G/I262L/S263A/ A521G/H748Y/P750S/A756T | + |
| 715/716 | R386V/R820A | S40A/P85E/V102S/V132Y/ S157G/I262L/S263A/R386V/ A521G/H748Y/P750S/R820A | + |
| 717/718 | R495E | S40A/P85E/V102S/V132Y/ S157G/I262L/S263A/ R495E/A521G/H748Y/P750S | + |
| 719/720 | T511M | S40A/P85E/V102S/ V132Y/S157G/I262L/S263A/ T511M/A521G/H748Y/P750S | + |
| 721/722 | F21C/S52R/P242Q/ R386V/R495E/R820A | F21C/S40A/S52R/P85E/V102S/ V132Y/S157G/I262L/S263A/P242Q/ R386V/R495E/A521G/H748Y/P750S/R820A | + |
| 723/724 | T299N/L476N/R495 | S40A/P85E/V102S/V132Y/ S157G/I262L/S263A/T299N/ L476N/R495E/A521G/H748Y/P750S | + |
| 725/726 | G706E | S40A/P85E/V102S/V132Y/ S157G/I262L/S263A/ A521G/G706E/H748Y/P750S | + |
| 727/728 | F21C/T299N/R386V/L476N/R495E | F21C/S40A/P85E/V102S/ V132Y/S157G/I262L/S263A/T299N/ R386V/L476N/R495E/A521G/H748Y/P750S | + |
| 729/730 | F21C/T299N/R322N/R495E | F21C/S40A/P85E/V102S/ V132Y/S157G/I262L/S263A/T299N/ R322N/R495E/A521G/H748Y/P750S | + |
| 731/732 | F21C/L476N/A849T | F21C/S40A/P85E/V102S/ V132Y/S157G/I262L/S263A/ L476N/A521G/H748Y/P750S/A849T | + |
| 733/734 | T299N/R322N/L476N/R820A | S40A/P85E/V102S/V132Y/ S157G/I262L/S263A/T299N/R322N/ L476N/A521G/H748Y/P750S/R820A | + |
| 735/736 | F21C/S52R/T299N/R322N/R820A | F21C/S40A/S52R/P85E/ V102S/V132Y/S157G/I262L/S263A/ T299N/R322N/A521G/H748Y/P750S/R820A | + |
| 737/738 | L20C/F21C/D566A | L20C/F21C/S40A/P85E/ V102S/V132Y/S157G/I262L/ S263A/A521G/D566A/H748Y/P750S | + |
| 739/740 | L20C/S52R | L20C/S40A/S52R/P85E/ V102S/V132Y/S157G/I262L/ S263A/A521G/H748Y/P750S | + |
| 741/742 | R322N/R386V/R495E/D566A/R820A | S40A/P85E/V102S/V132Y/ S157G/I262L/S263A/R322N/R386V/ R495E/A521G/D566A/H748Y/P750S/R820A | + |
| 743/744 | F21C/T299N | F21C/S40A/P85E/V102S/ V132Y/S157G/I262L/S263A/ T299N/A521G/H748Y/P750S | + |
| 745/746 | F21C/T299N/R386V | F21C/S40A/P85E/V102S/ V132Y/S157G/I262L/S263A/ T299N/R386V/A521G/H748Y/P750S | + |
| 747/748 | R386V/A849T | S40A/P85E/V102S/V132Y/ S157G/I262L/S263A/R386V/ A521G/H748Y/P750S/A849T | + |
| 749/750 | S52R/L476N | S40A/S52R/P85E/V102S/ V132Y/S157G/I262L/S263A/ L476N/A521G/H748Y/P750S | + |
| 751/752 | S52R/T299N/R322N/R386V/R495E | S40A/S52R/P85E/V102S/ V132Y/S157G/I262L/S263A/T299N/ R322N/R386V/R495E/A521G/H748Y/P750S | + |
| 753/754 | E440G | S40A/P85E/V102S/ V132Y/S157G/I262L/S263A/ E440G/A521G/H748Y/P750S | + |

Levels of increased activity were determined relative to the reference polypeptide of SEQ ID NO: 606 and defined as follows:
"+" > than 1-fold but less than 2-fold increased activity;
"++" > than 2-fold increased activity.

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656,

SEQUENCE LISTING (772 sequences)

SEQ ID NO: 1 - DNA, 2550 bp, synthetic construct
  misc_feature 1..2550: note = Taq21
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 2 - protein, 850 aa, synthetic construct
  REGION 1..850: note = Taq21
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 3 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccatctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 4 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDHLETVLYDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 5 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 6 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 7 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 8 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 9 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 10 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 11 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 12 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 13 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 14 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 15 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 16 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 17 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 18 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 19 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 20 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 21 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtacgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 22 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 23 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 24 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 25 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtacgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 26 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 27 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggctgcgggtcgtcgtaccgcgaagaccggtaaacgtagcaccagcgcgagcgttctggagaccctgcgtggtgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtgcttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 28 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRAFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 29 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 30 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 31 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 32 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 33 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 34 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 35 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 36 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 37 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 38 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPTFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 39 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 40 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 41 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcgcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 42 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREIARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 43 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 44 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 45 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaactgtcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtacgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 46 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSRELSRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 47 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 48 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKSTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 49 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgatcagctggagaccgttctgtatgatgaactgggtctggcggcgggtaagaagaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 50 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGKKTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 51 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgttcgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtgcttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 52 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLFDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRAFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 53 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 54 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVPGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 55 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 56 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 57 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 58 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 59 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 60 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 61 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 62 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 63 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 64 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 65 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggtgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 66 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 67 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 68 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 69 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccgactaacgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggccaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtaagcgcaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaaggccttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttatgcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgttcatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 70 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPTNAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGKRTAKTGKRSTSASVLETLRGAHPIVEKILQYRELAKLKGTYLDPLPKLVHPRTGRLHTRFHQTGTATGRLSSSDPNLQNIPIRTEIGRRIRKAFVAGEGYLLVVADYSQIELRVLAHLSGDENLIRIFQEGRDIHTQTAAWMFGVEDVEVDPFMRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 71 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgttcgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 72 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLFDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 73 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtacgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 74 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 75 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtgcttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 76 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRAFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 77 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 78 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 79 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactgtcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 80 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSRELSRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 81 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 82 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 83 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcgcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 84 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREIARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 85 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 86 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 87 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 88 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 89 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcgcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 90 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREIARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 91 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 92 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 93 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggtccacgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaaaaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgatcagctggagaccgttctgtatgatgaactgggtctggcggcgggtcgcaagaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtgggtgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaaaatcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 94 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRKTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWVFGVEDVEVDPFRRRAAKTINFGVLYGMSAHRLSRELGIDYGEAQAFIDRYFDSYPGVRAFMERVLEEARERGYVETLFGRRRHVPELLSKNRNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 95 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggtcaacgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggactttaaaccgcaggttgaaaagattaaacaactggttgatctgctgggtctggtgcgtctggaagtgccgggcgtggaggcggatgatgttctggccaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtgagaaatatggtgttggcccggagcaatgggtggattaccgtgcgctgaccggtgacccgagcgataacattccgggcgttcgtggtgtgggcgagaagaccgcggcgaaactgctggcgcgttggggtagcctggaccgtatttatgagcacctggatgaagttaccccgccgggtgtgcgtaaaaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaattgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgatcagctggagaccgttctgtatgatgaactgggtctggcggcgggtaagaagaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttatgcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 96 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVNAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLREKYGVGPEQWVDYRALTGDPSDNIPGVRGVGEKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGKKTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFMRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 97 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 98 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 99 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgttcgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 100 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLFDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 101 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 102 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 103 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 104 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 105 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatctcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccgattcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 106 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPIQGTAADLIKLAMVKLAPRLEPLGAALLLQVHDELVVEAPEERAAETARVVKATMEEAWRLDVPLAVEVGVGRDWLEAK

SEQ ID NO: 107 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 108 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 109 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgcggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggactgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggttgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgttcgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 110 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLRADGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDCIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLFDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 111 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggtcaacgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtaagcagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaaggccttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 112 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVNAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRKQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKAFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 113 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactgtcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 114 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELSRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 115 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtacgatgaactgggtctggctgcgggtcgtcgtaccgcgaagaccggtaaacgtagcaccagcgcgagcgttctggagaccctgcgtggtgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 116 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 117 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 118 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 119 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttacgccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 120 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVTPFRRRAAKTVNFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 121 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccgactaacgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaaaaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtaagcgcaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcacgtaacgtgcgtgaggcggcggaacgtgttgcgtttaacatgccggttcagggtaccgcggcggacatcattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 122 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPTNAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGKRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADIIKLAMVKLAPRLEPLGAALLLQVHDELVVEAPEERAAETARVVKATMEEAWRLDVPLAVEVGVGRDWLEAK

SEQ ID NO: 123 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgttcgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 124 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLFDELGLPAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 125 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccgtcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccgattcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 126 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTVNFGVLYGMSAHRLSRELGIDYGEAQAFIDRYFDSYPGVRAFMERVLEEARERGYVETLFGRRRHVPELLSKARNVREAAERVAFNMPIQGTAADLIKLAMVKLAPRLEPLGAALLLQVHDELVVEAPEERAAETARVVKATMEEAWRLDVPLAVEVGVGRDWLEAK

SEQ ID NO: 127 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 128 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 129 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 130 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 131 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 132 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKSTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 133 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtgcttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 134 - protein, 850 aa, synthetic construct
  REGION 1..850: note = Taq21 Variant
MHHHHHHGGSGMNGVQQPGLFQSKPERIVLVDGHHLAFRSFYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRAFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 135 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 136 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 137 - DNA, 2550 bp, synthetic construct
  misc_feature 1..2550: note = Taq21 Variant
  source 1..2550: mol_type = other DNA
atgcaccaccatcatcatcatggcggtagcggcatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtgcttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 138 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVPGVGAKTAAKLLARWGSLERIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRAFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 139 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggagcgtatttatgagcacctggatgaagttaccccgccgggtgtgcgtaagaaactggaggaaggccgtgaggcggcgttctttagccgtgaactgtcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 140 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLERIYEHLDEVTPPGVRKKLEEGREAAFFSRELSRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKSTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 141 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccgactaacgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagcacgatccgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgcaagaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtattctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 142 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPTNAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISTIRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRKTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGILYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 143 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 144 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 145 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactgtcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgttcgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtgcttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 146 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELSRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLFDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRAFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 147 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 148 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 149 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcgcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcacgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 150 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREIARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 151 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtcgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 152 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 153 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttacgccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 154 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVTPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 155 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacattaacagccgtgaccagctggagaccgttctgtacgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttaatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 156 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPTFRHEEFAGYKAQRVAPPEDFKPQVEKIKQLVDLLGLVRLEVPGYEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNINSRDQLETVLYDELGLAAGRRTAKTGKRSTSASVLETLRGAHPIVEKILQYRELAKLKSTYLDPLPKLVHPRTGRLHTRFNQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 157 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtagctactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcctggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgttcgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaagtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgcctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 158 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVPGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLFDELGLAAGRRTAKTGKRSTSASVLETLRGAHPIVEKILQYRELAKLKSTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 159 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgttcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccagcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcgcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctgcctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgttcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaagaagcggcggagaccgcgcgtgtggttaaggcgaccatggaggaagcgtggcgtctggacgtgccgctggcggttgaggtgggtgtgggtcgtgattggctggaagcgaaa

SEQ ID NO: 160 - protein, 850 aa, synthetic construct
  REGION 1..850: note = Taq21 Variant
MHHHHHHGGSGMNGVQQPGLFQSKPERIVLVDGHHLAFRSYYALKDAGLSTSSGEPVHAVYGFARTLLKLLREDGDCVIVVFDAPGPSFRHEEFAGYKAQRVAPPEDFKPQVEKIKQLVDLLGLVRLEVPGVEADDVLATLARRAEREGYEVVILTSDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREIARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLPAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEEEAAETARVVKATMEEAWRLDVPLAVEVGVGRDWLEAK

SEQ ID NO: 161 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgttctatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgaccttccgtcacgaggaatttgcgggctataaagcgcagcgtgtggctccgccggaggacttcaaaccgcaggttgaaaagattaaacaactggttgatctgctgggtctggtgcgtctggaagtgccgggcgtggaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaaatcagccgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcggcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgtcatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgtgcggcggagaccgcgcgtgtggttaaggcgaccatggaggaagcgtggcgtctggacgtgccgctggcggttgaggtgggtgtgggtcgtgattggctggaagcgaaa

SEQ ID NO: 162 - protein, 850 aa, synthetic construct
  REGION 1..850: note = Taq21 Variant
MHHHHHHGGSGMNGVQQPGLFQSKPERIVLVDGHHLAFRAFYALKDAGLSTSSGEPVHAVYGFARTLLKLLREDGDCVIVVFDAPGPTFRHEEFAGYKAQRVAPPEDFKPQVEKIKQLVDLLGLVRLEVPGVEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSREISRMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRHVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 163 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgtctctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 164 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPSLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 165 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtgggcgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 166 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGGRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 167 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcttggatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 168 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSLDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 169 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccatctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 170 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHHLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 171 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgtggggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 172 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLWGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 173 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaggcgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 174 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGRRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 175 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgttttaccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 176 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILFYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 177 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcgttagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 178 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSVSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 179 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaatacatggaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 180 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYMELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 181 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctggtgagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 182 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLVSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 183 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgtggagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 184 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLWSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 185 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagggttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 186 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSARVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 187 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcataagaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 188 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHKTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 189 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccggggaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 190 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPGNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 191 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgagccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 192 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSEPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 193 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgaagtaccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtattttccaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 194 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILKYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 195 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagccggaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 196 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSRNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 197 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcgtatgaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 198 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAYERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 199 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggtggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 200 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREVAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 201 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccggagcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 202 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPERTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 203 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtccgcgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 204 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGPRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 205 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccctgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 206 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSPDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 207 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgggaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 208 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTGTGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 209 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactgagtaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 210 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELSKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 211 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgaattaccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 212 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILNYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 213 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgccgctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 214 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAPLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 215 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccgcatctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 216 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPHLLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 217 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtacctcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 218 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTSTGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 219 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtacgtatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 220 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRTYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 221 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagatgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 222 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKMKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 223 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcacgtgctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 224 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHVLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 225 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggaggtgctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 226 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLEVLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 227 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgtgtagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 228 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLCSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 229 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgttggctggcgaagctgaaaggtacctatctggacccgctgccgaaactggttcatccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 230 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRWLAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 231 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtacccggaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 232 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTRTGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 233 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgtggaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 234 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPAWTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 235 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaacatgcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 236 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYREHAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 237 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgggtctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 238 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAGLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 239 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgacgctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 240 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPTLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 241 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcttatggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 242 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAYGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 243 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccggcgcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 244 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPARTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 245 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcggatctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 246 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELADLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 247 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcacccatgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 248 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTHASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 249 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggcgggctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 250 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGGLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 251 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagccctagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 252 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSPSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 253 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagacctcgaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 254 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTSKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 255 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtgggaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagtagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 256 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRGTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 257 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatcggccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 258 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYRPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 259 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgttatgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 260 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERYAFNMPVQGTAADLIKLAMVKLAPRLEPLGAALLLQVHDELVVEAPEERAAETARVVKATMEEAWRLDVPLAVEVGVGRDWLEAK

SEQ ID NO: 261 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtcctctggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 262 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRPLAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 263 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagccctagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 264 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSPSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 265 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagccagagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 266 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSQSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 267 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacgtgccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 268 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNVPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 269 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcggtctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 270 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASGLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 271 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtacctggaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 272 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTWTGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 273 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgattggaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 274 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDWNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 275 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttaagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgaggaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 276 - protein, 850 aa, synthetic construct
  REGION 1..850: note = Taq21 Variant
MHHHHHHGGSGMNGVQQPGLFKSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPARTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 277 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaatactgggaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 278 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYWELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 279 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctgcggaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 280 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLRTLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 281 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacagagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 282 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKQSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 283 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacgctcgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 284 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHARFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 285 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgagggatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 286 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVRDELVVEAPEERAAETARVVKATMEEAWRLDVPLAVEVGVGRDWLEAK

SEQ ID NO: 287 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttgcggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 288 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVAETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 289 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaacactccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 290 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNTPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 291 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccgcagagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 292 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPQSTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 293 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcttgctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 294 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASLLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 295 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcaggagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 296 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSRSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 297 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcacctgggcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 298 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTWASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 299 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaacagtccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 300 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNSPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 301 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggcgttctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 302 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGVLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 303 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggcttggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 304 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAWGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 305 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacgggccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 306 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNGPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 307 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgattaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 308 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPINNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 309 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcgcgagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 310 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSASDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 311 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagcaggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 312 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREQAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 313 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggctggcgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 314 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGWRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 315 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggttaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 316 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELVKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 317 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgtggaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 318 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAWTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 319 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagctgggatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 320 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSWDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 321 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaactggccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 322 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNWPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 323 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagtggggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 324 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKWGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 325 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgatgagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 326 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLMSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 327 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaacccagaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 328 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTQTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 329 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtgtgcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 330 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGVRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 331 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 332 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 333 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactgcgtaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 334 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELRKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 335 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtaatagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 336 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRNSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 337 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtgtggcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 338 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRVAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 339 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatcttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 340 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYLPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 341 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacgttaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 342 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNVNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 343 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcggtgaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 344 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAVTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 345 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaagagcgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 346 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQERELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 347 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcaagagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 348 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSKSVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 349 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggcactctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 350 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGTLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 351 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaaggcgggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 352 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKAGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 353 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcggaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 354 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHRTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 355 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggctgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccggcgaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 356 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPANNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 357 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaatgggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 358 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQMGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 359 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcgattcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 360 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAIRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 361 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtatgctggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 362 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRMLAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 363 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcgggggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 364 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAGERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 365 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccgaagagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 366 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPKSTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 367 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacaccttttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 368 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTFFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 369 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagcatctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 370 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLEHLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 371 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaaggggaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 372 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKGKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 373 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcgggaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 374 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSGNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 375 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgcagagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 376 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLQSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 377 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctgcttaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 378 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLLTLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 379 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaagttatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 380 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQVIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 381 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtgctcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 382 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGARTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 383 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatactccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 384 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYTPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 385 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgactggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 386 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLTGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 387 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggcgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 388 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAARVAFNMPVQGTAADLIKLAMVKLAPRLEPLGAALLLQVHDELVVEAPEERAAETARVVKATMEEAWRLDVPLAVEVGVGRDWLEAK

SEQ ID NO: 389 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtaagcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 390 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGKRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 391 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaatgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 392 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRNEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 393 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtcttgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 394 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRLAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 395 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacctgcaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 396 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNLQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 397 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccacgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 398 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTTKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 399 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagcggggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 400 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKRGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 401 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccggggctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 402 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPGLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 403 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagctggctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 404 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASWLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 405 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgtgtgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 406 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVCDELVVEAPEERAAETARVVKATMEEAWRLDVPLAVEVGVGRDWLEAK

SEQ ID NO: 407 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgttttctggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 408 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRFLAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 409 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaaggggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 410 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYREGAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 411 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgatgaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 412 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLMNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 413 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagggatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 414 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSRDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 415 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtctgtatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 416 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGLYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 417 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcctaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 418 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLPNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 419 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttaggggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 420 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVRGTAADLIKLAMVKLAPRLEPLGAALLLQVHDELVVEAPEERAAETARVVKATMEEAWRLDVPLAVEVGVGRDWLEAK

SEQ ID NO: 421 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcggtaccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 422 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILRYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 423 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgatgggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 424 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLMGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 425 - DNA, 2550 bp, synthetic construct
  misc_feature 1..2550: note = Taq21 Variant
  source 1..2550: mol_type = other DNA
atgcatcaccatcaccatcacggtggcagtggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgacgagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 426 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLTSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 427 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagccttagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 428 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSLSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 429 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacatttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcactagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 430 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYIFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 431 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaatacaaggaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 432 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYKELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 433 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgggtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 434 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLGGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 435 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagcagggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 436 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKQGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 437 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaacagcccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgggcggcgcgcacccgatcgtggagaagattctgcaataccgtgaactggcgaagctgaaaggtacctatctggacccgctgccgaaactggttcacccgcgtaccggccgtctgcacacgcgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagatggcggagcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 438 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNSPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLGGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREMAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 439 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccagccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcagaccgcgaagaccggtaaacgtagcaccagcgcgagcgttctggagaccctgggcggcgcgcacccgatcgtggagaagattctgcaataccgtgaactggcgaagctgaaaggtacctatctggacccgctgccgaaactggttcacccgcgtaccggccgtctgcacgcgcgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagatggcggtgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 440 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRQTAKTGKRSTSASVLETLGGAHPIVEKILQYRELAKLKGTYLDPLPKLVHPRTGRLHARFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREMAVRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 441 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaacagcccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcagaccgcgaagaccggtaaacgtagcaccagcgcgagcgttctggagaccctgggcggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccctgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagatggcggtgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 442 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNSPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRQTAKTGKRSTSASVLETLGGAHPIVEKILQYRELAKLKGTYLDPLPKLVHPRTGRLHTRFHQTGTLTGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREMAVRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 443 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgcggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggccgcggtgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 444 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAVRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 445 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaaccgcagcccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcagaccgcgaagaccggtaaacgtagcaccagcgcgagcgttctggagaccctgggcggcgcgcacccgatcgtggagaagattctgcaataccatgaactggcgaagctgaaaggtacttatctggacccgctgccgaaactggttcacccgcgtaccggccgtctgcacacgcgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagatggcggtgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 446 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNRSPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRQTAKTGKRSTSASVLETLGGAHPIVEKILQYHELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREMAVRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 447 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 448 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 449 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgggcggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagatggcggtgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 450 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLGGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREMAVRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 451 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaaaaggttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 452 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMEKVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 453 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccggagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 454 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 455 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgattgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 456 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLIALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 457 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatttgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 458 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDLFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 459 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaacgaaa

SEQ ID NO: 460 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 461 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 462 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 463 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 464 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 465 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagccctgcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 466 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSPARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 467 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtcgcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctagaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 468 - protein, 850 aa, synthetic construct
  REGION 1..850: note = Taq21 Variant
MHHHHHHGGSGMNGVQQPGLSQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 469 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccaggtcgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 470 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPGRAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 471 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcgcttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 472 - protein, 850 aa, synthetic construct
  REGION 1..850: note = Taq21 Variant
MHHHHHHGGSGMNGVQQPGAFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 473 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgaagcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 474 - protein, 850 aa, synthetic construct
  REGION 1..850: note = Taq21 Variant
MHHHHHHGGSGMNGVQQPGLKQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 475 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtaatagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 476 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGNSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 477 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaagggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 478 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 479 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcggcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtctgcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 480 - protein, 850 aa, synthetic construct
  REGION 1..850: note = Taq21 Variant
MHHHHHHGGSGMNGVRQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARLRGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 481 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgcagcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 482 - protein, 850 aa, synthetic construct
  REGION 1..850: note = Taq21 Variant
MHHHHHHGGSGMNGVQQPGLQQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 483 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcccttatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 484 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIPYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 485 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtggtcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 486 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARGRGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 487 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgtttatgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 488 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVYARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 489 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagctgggaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 490 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSWELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 491 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtatggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 492 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRMAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 493 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaagggctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 494 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEGLGAALLLQVHDELVVEAPEERAAETARVVKATMEEAWRLDVPLAVEVGVGRDWLEAK

SEQ ID NO: 495 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaatcggcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 496 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPESAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 497 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 498 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 499 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaggctggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 500 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPRLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 501 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagcgttgaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 502 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSVELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 503 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctggttagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 504 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELVSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 505 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgaagagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 506 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELKSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 507 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccagccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcagaccgcgaagaccggtaaacgtagcaccagcgcgagcgttctggagaccctgcgtggcgcgcacccgatcgtggagaagattctgcaataccgtgaactggcgaagctgaaaggtacttatctggacccgctgccgaaactggttcacccgcgtaccggccgtctgcacgcgcgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggccgcggagcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 508 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRQTAKTGKRSTSASVLETLRGAHPIVEKILQYRELAKLKGTYLDPLPKLVHPRTGRLHARFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 509 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtaaggaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 510 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRKEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 511 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgctgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 512 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPLGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 513 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgagtggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 514 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPSGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 515 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgaggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 516 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDEEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 517 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgtcgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 518 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDASGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 519 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacatgctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 520 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHMLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 521 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgctcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgttgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 522 - protein, 850 aa, synthetic construct
  REGION 1..850: note = Taq21 Variant
MHHHHHHGGSGMNGAQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 523 - DNA, 2550 bp, synthetic construct
  misc_feature 1..2550: note = Taq21 Variant
  source 1..2550: mol_type = other DNA
atgcatcaccatcaccatcacggtggcagcggtatgaacggtaatcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 524 - protein, 850 aa, synthetic construct
  REGION 1..850: note = Taq21 Variant
MHHHHHHGGSGMNGNQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 525 - DNA, 2550 bp, synthetic construct
  misc_feature 1..2550: note = Taq21 Variant
  source 1..2550: mol_type = other DNA
atgcatcaccatcaccatcacggtggcagcggtatgaacggtaagcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 526 - protein, 850 aa, synthetic construct
  REGION 1..850: note = Taq21 Variant
MHHHHHHGGSGMNGKQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 527 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcggtggttaaggcgaccatggaggaagcgtggcgtctggacgtgccgctggcggttgaggtgggtgtgggtcgtgattggctggaagcgaaa

SEQ ID NO: 528 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 529 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 530 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 531 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggagggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 532 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 533 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgaggggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 534 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDARGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 535 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagcgaggaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 536 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSEELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 537 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgggcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 538 - protein, 850 aa, synthetic construct
  REGION 1..850: note = Taq21 Variant
MHHHHHHGGSGMNGGQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 539 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacagggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 540 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDREVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 541 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagctaaa

SEQ ID NO: 542 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 543 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcacccgcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 544 - protein, 850 aa, synthetic construct
  REGION 1..850: note = Taq21 Variant
MHHHHHHGGSGMNGVQQPGLCQSKPERIVLVDGHHLAFRAYYALKDAGLSTRSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 545 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 546 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 547 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgtgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacagtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagcgaaa

SEQ ID NO: 548 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRVLTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHSLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 549 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 550 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 551 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 552 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 553 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagcgaaa

SEQ ID NO: 554 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 555 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 556 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 557 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcggatcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagcgaaa

SEQ ID NO: 558 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLADHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 559 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 560 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 561 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgacccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 562 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 563 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 564 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 565 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 566 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 567 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 568 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 569 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaaactaaa

SEQ ID NO: 570 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLETK

SEQ ID NO: 571 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 572 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 573 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 574 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 575 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 576 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 577 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 578 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 579 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagcgaaa

SEQ ID NO: 580 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 581 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 582 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 583 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 584 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 585 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacagtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 586 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHSLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 587 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 588 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 589 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagcgaaa

SEQ ID NO: 590 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 591 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 592 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 593 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacagtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 594 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHSLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 595 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 596 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 597 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagctaaa

SEQ ID NO: 598 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 599 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcacccgcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 600 - protein, 850 aa, synthetic construct
  REGION 1..850: note = Taq21 Variant
MHHHHHHGGSGMNGVQQPGCFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 601 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcacccgcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactgattcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 602 - protein, 850 aa, synthetic construct
  REGION 1..850: note = Taq21 Variant
MHHHHHHGGSGMNGVQQPGLCQSKPERIVLVDGHHLAFRAYYALKDAGLSTRSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLIHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 603 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaactaaa

SEQ ID NO: 604 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 605 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 606 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 607 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 608 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 609 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacatggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaactaaa

SEQ ID NO: 610 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDMDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 611 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 612 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 613 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 614 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 615 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacgaactggcgggtcacccgttcaacctgaacagccgtgaccagctggagaccgttctgtatgatgaactgggtctggctgggggtcgccgtaccgcgaagaccggtaaacgtagcaccagcgcgagcgttctggagaccctgcgtggcgcgcacccgatcgtggagaagattctgcaataccgtgaactggcgaagctgaaaggtacctatctggccccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaaactaaa

SEQ ID NO: 616 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLAPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 617 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 618 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 619 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacagtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 620 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHSLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 621 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 622 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 623 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacagtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaaactaaa

SEQ ID NO: 624 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHSLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLETK

SEQ ID NO: 625 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacagtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 626 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHSLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 627 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 628 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 629 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaactaaa

SEQ ID NO: 630 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 631 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccacgaactggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 632 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 633 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaacgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaactaaa

SEQ ID NO: 634 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 635 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaatgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcagacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagcgaaa

SEQ ID NO: 636 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 637 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgttttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggccccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggccgtggttaaggcgaccatggaggaagcgtggcgtctggacgtgccgctggcggttgaggtgggtgtgggtcgtgattggctggaagcgaaa

SEQ ID NO: 638 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLAPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 639 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtcccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaaactaaa

SEQ ID NO: 640 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 641 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggccccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 642 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLAPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 643 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaaactaaa

SEQ ID NO: 644 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLETK

SEQ ID NO: 645 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 646 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 647 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaaacgcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 648 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDETRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 649 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 650 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 651 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 652 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 653 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctttcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 654 - protein, 850 aa, synthetic construct
  REGION 1..850: note = Taq21 Variant
MHHHHHHGGSGMNGVQQPGCFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 655 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 656 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 657 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 658 - protein, 850 aa, synthetic construct; identical to SEQ ID NO: 598
  REGION 1..850: note = Taq21 Variant

SEQ ID NO: 659 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 660 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 661 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 662 - protein, 850 aa, synthetic construct
  REGION 1..850: note = Taq21 Variant
MHHHHHHGGSGMNGVQQPGCFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 663 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 664 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 665 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 666 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 667 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 668 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 669 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 670 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 671 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 672 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 673 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 674 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 675 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 676 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 677 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 678 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 679 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 680 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 681 - DNA, 2550 bp, synthetic construct; identical to SEQ ID NO: 463
  misc_feature 1..2550: note = Taq21 Variant
  source 1..2550: mol_type = other DNA

SEQ ID NO: 682 - protein, 850 aa, synthetic construct; identical to SEQ ID NO: 464
  REGION 1..850: note = Taq21 Variant

SEQ ID NO: 683 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattggggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 684 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDWGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 685 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 686 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 687 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 688 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 689 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 690 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 691 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 692 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 693 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 694 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 695 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 696 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 697 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcccgccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 698 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFPPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 699 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 700 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 701 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggagggggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 702 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEGEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 703 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 704 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 705 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 706 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 707 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 708 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 709 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggccccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 710 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLAPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 711 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 712 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 713 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaaactcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 714 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKTRNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 715 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 716 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 717 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 718 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 719 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagatggttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 720 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLEMVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 721 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttacccagccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 722 - protein, 850 aa, synthetic construct
  REGION 1..850: note = Taq21 Variant
MHHHHHHGGSGMNGVQQPGLCQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTQPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 723 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 724 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 725 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatgaggaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 726 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYEEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 727 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 728 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 729 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 730 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 731 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaactaaa

SEQ ID NO: 732 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 733 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 734 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 735 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 736 - protein, 850 aa, synthetic construct
  REGION 1..850: note = Taq21 Variant
MHHHHHHGGSGMNGVQQPGLCQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 737 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggccccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 738 - protein, 850 aa, synthetic construct
  REGION 1..850: note = Taq21 Variant
MHHHHHHGGSGMNGVQQPGCCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLAPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 739 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggctgctttcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 740 - protein, 850 aa, synthetic construct
  REGION 1..850: note = Taq21 Variant
MHHHHHHGGSGMNGVQQPGCFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 741 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggccccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcggcagtggttaaggcgaccatggaggaagcgtggcgtctggacgtgccgctggcggttgaggtgggtgtgggtcgtgattggctggaagctaaa

SEQ ID NO: 742 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLAPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETAAVVKATMEEAWRLDVPLAVEVGVGRDWLEAK

SEQ ID NO: 743 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 744 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 745 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtgtcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccactgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 746 - protein, 850 aa, synthetic construct
  REGION 1..850: note = Taq21 Variant
MHHHHHHGGSGMNGVQQPGLCQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 747 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaaactaaa

SEQ ID NO: 748 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLETK

SEQ ID NO: 749 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgaatgcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 750 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLNALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 751 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcacccgtagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggtgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaacctgctgcgtgaactgggcctgattcaggcgccggaggcgcaagaagcggcgtggccgccgccagaaaacgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcggtgccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccacgagctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagctaaa

SEQ ID NO: 752 - protein, 850 aa, synthetic construct
  REGION 1..850: note = Taq21 Variant
MHHHHHHGGSGMNGVQQPGLFQSKPERIVLVDGHHLAFRAYYALKDAGLSTRSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGNLLRELGLIQAPEAQEAAWPPPENAWLGYVFDRPEPMWAELGQLAAAWDERVAEGPARALELERFPQLDAVQAKDLTVWALREGVRAVPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHELAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 753 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcggaaggtccgagcttccgtcacgaggaatttgcgggctataaagcgcagcgttcggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgcgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggggggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgtttcggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgcgtggttaaggcgaccatggaggaagcgtggcgtctggacgtgccgctggcggttgaggtgggtgtgggtcgtgattggctggaagctaaa

SEQ ID NO: 754 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAEGPSFRHEEFAGYKAQRSAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLGGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVSELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 755 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaacctctaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 756 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTSTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 757 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactgcagaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 758 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELQKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 759 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaaccggcaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 760 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNRQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 761 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgaagtaccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 762 - protein, 850 aa, synthetic construct; identical to SEQ ID NO: 194
  REGION 1..850: note = Taq21 Variant

SEQ ID NO: 763 - DNA, 2550 bp, synthetic construct; identical to SEQ ID NO: 315
  misc_feature 1..2550: note = Taq21 Variant
  source 1..2550: mol_type = other DNA

SEQ ID NO: 764 - protein, 850 aa, synthetic construct; identical to SEQ ID NO: 316
  REGION 1..850: note = Taq21 Variant

SEQ ID NO: 765 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgagatggcggaacgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 766 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREMAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 767 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaacaaccaaccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgcgggtcgtcgtaccgcgaagaccggtaaacgtagcaccagcgcgagcgttctggagaccctgcgtggcgcgcacccgatcgtggagaagattctgcaataccgtgaactggcgaagctgaaaggtacctatctggacccgctgccgaaactggttcacccgcgtaccggccgtctgcacacccgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggcggcggtgcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 768 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNNQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAAGRRTAKTGKRSTSASVLETLRGAHPIVEKILQYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAVRVAFNMPVQGTAADLIKLAMVKLAPRLEPLGAALLLQVHDELVVEAPEERAAETARVVKATMEEAWRLDVPLAVEVGVGRDWLEAK

SEQ ID NO: 769 - DNA, 2550 bp, synthetic construct
  misc_feature 1..2550: note = Taq21 Variant
  source 1..2550: mol_type = other DNA
atgcatcaccatcaccatcacggtggcagcggtatgaacggtgttcagcaaccgggcctgtttcagagcaagccggaacgtatcgtgctggttgacggtcaccacctggcgttccgtgcgtactatgcgctgaaagatgcgggtctgagcaccagcagcggtgaaccggttcatgcggtgtacggttttgcgcgtaccctgctgaagctgctgcgtgaggacggcgattgcgttatcgtggtttttgatgcgccgggtccgagcttccgtcacgaggaatttgcgggctataaagcgcagcgtgtggctccgccggaggacttcaaaccgcaggttgaaaagattaaacaactggttgatctgctgggtctggtgcgtctggaagtgccgggctacgaggcggatgatgttctggcgaccctggcgcgtcgtgcggagcgtgaaggttacgaggtggttatcctgaccggcgaccgtgatacctatcaactgctgaccgaccgtgtggttgtggttaccccggacgaacgtcgtattaccccggattacctgcgtcagaaatatggtgttggcccggagcaatgggtggattaccgtgcgctgaccggtgacccgagcgataacattccgggcgttcgtggtgtgggcgcgaagaccgcggcgaaactgctggcgcgttggggtagcctggaccgtatttatgagcacctggatgaagttaccccgccgggtgtgcgtaagaaactggaggaaggccgtgaggcggcgttctttagccgtgaactggcgcgtatgcgtgcggacgttccgctggacgtggatctgaccggttgccaccgtaacgaggtggaccgtgaaggcctgcgtcgtttcctgctggatctggagtttggtaccctgctgcgtgaactgggcctgattcaggcgccggaggcgcaagaagcggcgtggccgccgccagaacgtgcgtggctgggttacgtttttgatcgtccggagccgatgtgggcggaactgggtcagctggcggcggcgtgggatgaacgtgtggcggaaggtccggcgcgtgcgctggagctggaacgtttcccgcagctggacgcggttcaagcgaaggatctgaccgtttgggcgctgcgtgagggtgttcgtgcgcgtccgggtgatgatccgctgctgctggcgtacctgtatgacccgagcaaccgccagccggcgagcaccgttcgtcgttatggtgttggtgactggaccgatcgtgcgcgtgaccgtgcgctggcggcgcgttggctgtggcgtgagatgagcgatcgtctggaaggtgaagaacgtctgtggtggctgtaccgtgaggtggaacgtccgctgcagggtgttctggcggcgatggaacgtcgtggcgttaaactggacgtggattatctgctggcgctgagccaagaactggcggcggagctggaacgtctggaggcggaaatccaccgtctggcgggtcacccgttcaacctgaacagccgtgaccagctggagaccgttctgtatgatgaactgggtctggctgggggtcgtcgtaccgcgaagaccggtaaacgtagcaccagcgcgagcgttctggagaccctgcgtggcgcgcacccgatcgtggagaagattctgaaataccgtgaactggcgaagctgaaaggtacttatctggacccgctgccgaaactggttcacccgcgtaccggccgtctgcacacgcgttttcatcaaaccggtaccgcgaccggccgtctgagcagcagcgatccgaacctgcaaaacatcccgattcgtaccgagatcggtcgtcgtattcgtaagggcttcgttgcgggtgaaggctacctgctggttgtggcggactatagccagattgagctgcgtgtgctggcgcacctgagcggtgacgagaacctgatccgtatttttcaggaaggccgtgatattcacacccaaaccgcggcgtggatgttcggtgttgaggacgtggaagttgatccgtttcgtcgtcgtgcggcgaaaaccatcaacttcggtgttctgtacggcatgagcgcgcaccgtctgagccgtgagctgggtatcgattatggcgaagcgcaggcgttcattgaccgttactttgatagctatccgggcgtgcgtgcgtttatggaacgtgttctggaggaagcgcgtgagcgtggttacgtggaaaccctgttcggccgtcgtcgttatgttccggagctgctgagcaaagcgcgtaacgtgcgtgaggccgcggagcgtgttgcgtttaacatgccggttcagggtaccgcggcggacctgattaagctggcgatggttaaactggcgccgcgtctggaaccgctgggcgcggcgctgctgctgcaagtgcacgatgagctggttgtggaagcgccggaggaacgcgcggcggagaccgcgcgtgtggttaaggcgaccatggaggaagcgtggcgtctggacgtgccgctggcggttgaggtgggtgtgggtcgtgattggctggaagcgaaa

SEQ ID NO: 770 - protein, 850 aa, synthetic construct
  REGION 1..850: note = Taq21 Variant
MHHHHHHGGSGMNGVQQPGLFQSKPERIVLVDGHHLAFRAYYALKDAGLSTSSGEPVHAVYGFARTLLKLLREDGDCVIVVFDAPGPSFRHEEFAGYKAQRVAPPEDFKPQVEKIKQLVDLLGLVRLEVPGYEADDVLATLARRAEREGYEVVILTGDRDTYQLLTDRVVVVTPDERRITPDYLRQKYGVGPEQWVDYRALTGDPSDNIPGVRGVGAKTAAKLLARWGSLDRIYEHLDEVTPPGVRKKLEEGREAAFFSRELARMRADVPLDVDLTGCHRNEVDREGLRRFLLDLEFGTLLRELGLIQAPEAQEAAWPPPERAWLGYVFDRPEPMWAELGQLAAAWDERVAEGPARALELERFPQLDAVQAKDLTVWALREGVRARPGDDPLLLAYLYDPSNRQPASTVRRYGVGDWTDRARDRALAARWLWREMSDRLEGEERLWWLYREVERPLQGVLAAMERRGVKLDVDYLLALSQELAAELERLEAEIHRLAGHPFNLNSRDQLETVLYDELGLAGGRRTAKTGKRSTSASVLETLRGAHPIVEKILKYRELAKLKGTYLDPLPKLVHPRTGRLHTRFHQTGTATGRLSSSDPNLQNIPIRTEIGRRIRKGFVAGEGYLLVVADYSQIELRVLAHLSGDENLIRIFQEGRDIHTQTAAWMFGVEDVEVDPFRRRAAKTINFGVLYGMSAHRLSRELGIDYGEAQAFIDRYFDSYPGVRAFMERVLEEARERGYVETLFGRRRYVPELLSKARNVREAAERVAFNMPVQGTAADLIKLAMVKLAPRLEPLGAALLLQVHDELVVEAPEERAAETARVVKATMEEAWRLDVPLAVEVGVGRDWLEAK

SEQ ID NO: 771 - DNA, 19 bp, synthetic construct
  misc_feature 1..19: note = Primer SeqF1
  source 1..19: mol_type = other DNA
ccaatacgcaaaccgcctc

SEQ ID NO: 772 - DNA, 21 bp, synthetic construct
  misc_feature 1..21: note = Primer SeqR1
  source 1..21: mol_type = other DNA
caacggtggtatatccagtga

What is claimed is:

1. An engineered DNA polymerase, comprising a polypeptide sequence having at least 90%, or more sequence identity to a reference sequence corresponding to residues 12 to 850 of SEQ ID NO: 606, or to a reference sequence corresponding to SEQ ID NO: 606, wherein the polypeptide sequence comprises at least a substitution at amino acid position 40, 85, 102, 132, 157, 177, 262, 263, 503, 748, or 750, or substitution 521G/W/Y, or combinations thereof, relative to the reference sequence corresponding to residues 12 to 850 of SEQ ID NO: 2, or to the reference sequence corresponding to SEQ ID NO: 2.

2. The engineered DNA polymerase of claim 1, wherein the polypeptide sequence comprises at least a substitution 40A, 85E/R/S, 102V/M, 132Y, 157G, 177T, 262L, 263A, 503I/V, 521G/W/Y, or 750S/P, or combinations thereof, wherein the amino acid positions are relative to SEQ ID NO: 2.

3. The engineered DNA polymerase of claim 2, wherein the polypeptide sequence comprises at least a substitution 40A, 85E, 102V, 132Y, 157G, 177T, 262L, 263A, 521G, 748Y, or 750S, or combinations thereof, wherein the amino acid positions are relative to the reference sequence of SEQ ID NO: 2.

4. The engineered DNA polymerase of claim 1, wherein the DNA polymerase comprises a polypeptide sequence comprising residues 12 to 850 of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, or 770.

5. The engineered DNA polymerase of claim 1, wherein the DNA polymerase comprises a polypeptide sequence comprising SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 440, 442, 444, 446, 448, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 565, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, or 770.

6. The engineered DNA polymerase of claim 1, having at least one improved property selected from increased activity, increased stability, increased thermostability, increased processivity, increased fidelity, and increased product yield in a PCR reaction, compared to a reference DNA polymerase.

7. A composition comprising at least one engineered DNA polymerase of claim 1.

8. A method of preparing a complementary DNA of a target DNA, comprising contacting a target DNA with an engineered DNA polymerase of claim 1 in presence of substrates under conditions suitable for production of a complementary DNA to all or a portion of the target DNA.

9. A method for detecting presence of a target DNA, comprising contacting a sample suspected of containing a target DNA with an engineered DNA polymerase of claim 1 in presence of substrates under conditions suitable for DNA polymerase mediated production of a DNA complementary to all or a portion of the target DNA, and detecting presence of the complementary DNA.

10. A method of amplifying a target DNA, comprising contacting a target DNA with a DNA polymerase of claim 1 in presence of substrates under conditions suitable for amplifying the target DNA.

11. A method of sequencing a target DNA, comprising contacting a target DNA with a DNA polymerase of claim 1 in presence of substrates appropriate for sequencing under conditions suitable for DNA polymerase mediated extension of a complementary DNA of the target DNA, and determining the sequence of the target DNA.

12. A kit comprising at least one engineered DNA polymerase of claim 1.

13. The engineered DNA polymerase of claim 1, wherein the polypeptide sequence comprises at least a substitution or substitution set at amino acid position 213/503/508/584/748, 40/132/748, 40/132/157/262/263/748, 40/132/503/748, 40/132/157/503/562, 40/132/213/748/814, 132/157/562/584, 132/584/748, 40/132/231/684/748, 40/132, 40/41/132/562/684/748, 41/213/231/503/650/674/748, 132/231/503/748, 40/132/157/503, 503/748/814, 40/132/231/503/674/748, 40/88/132/503/684/748, 132/157/213/674/748/814, 157/263/748, 40/748, 41/157/231/262/748/814, 40/213/503/562/584/748, 523/524, 40/132/503/514/650/674, 40/132/157/213/231, 40/41/157/231/503, 40/157/503, 40/132/562/748, 132/748, 40/41/132/562/748, 88/213/503/584/684/748, 40/213/231/503/514/562/748, 132/562, 213/503/650, 40/41/88/231/748/814, 41/213/262/562, 213/263/748, 40/157/213, 157/520, 40/132/263/503/674/814, 40/41, 524/665/756, 40/41/748, 132/514, 520, 41/213/503/562, 231/503/748/772, 503/562, 132/262/520/562/684/748, 88/562/814, 41/88/157/814, 88/157/213/674/684, 40/132/157/514/520/684, 40/41/213/684/772, 40/41/231/503/814, 88/213/503/584/814, 40/41/132/562/584, 41/88/213/231/503/650/748, 40/503, 40/132/213/231/520/562/650/814, 40/41/132/231/262/503/562/584/748/814, 88/132/157/262/263/520/562, 88/132/157/262/503/514/562/650, 40/584/674/748, 40/41/132/263/503, 584/748, 40/213/674, 40/41/88T/132/503/562/584/748, 263/520/814, 40/41/88/157, wherein the amino acid positions are relative to the reference sequence of SEQ ID NO: 2.

14. The engineered DNA polymerase of claim 1, wherein the polypeptide sequence comprises at least a substitution or substitution set 213P/503I/508H/584N/748Y; 40A/132Y/748Y; 40A/132Y/157G/262L/263A/748Y; 40A/132Y/503I/748Y; 40A/132Y/157G/503I/562S; 40A/132Y/213P/748Y/814E; 132Y/157G/562S/584N; 132Y/584N/748Y; 40A/132Y/231E/684V/748Y; 40A/132Y; 40A/41F/132Y/562S/684V/748Y; 41F/213P/231E/503I/650A/674T/748Y; 132Y/231E/503I/748Y; 40A/132Y/157G/503I; 503I/748Y/814E; 40A/132Y/231E/503I/674T/748Y; 40A/88T/132Y/503I/684V/748Y; 132Y/157G/213P/674T/748Y/814E; 157G/263A/748Y; 40A/748Y; 41F/157G/231E/262L/748Y/814E; 40A/213P/503I/562S/584N/748Y; 40A/132Y/503I/514F/650A/674T; 40A/132Y/157G/213P/231E; 40A/41F/157G/231E/503I; 40A/157G/503I; 40A/132Y/562S/748Y; 132Y/748Y; 40A/41F/132Y/562S/748Y; 88T/213P/503I/584N/684V/748Y; 40A/213P/231E/503I/514F/562S/748Y; 132Y/562S; 213P/503I/650A; 40A/41F/88T/231E/748Y/814E; 41F/213P/262L/562S; 213P/263A/748Y; 40A/157G/213P; 157G/520P; 40A/132Y/263A/503I/674T/814E; 40A/41F; 524K/665V/756N; S40A/Y41F/748Y; 132Y/514F; 41F/213P/503I/562S; 231E/503I/748Y/772I; 503I/562S; 132Y/262L/520P/562S/684V/748Y; 88T/562S/814E; 41F/88T/157G/814E; 88T/157G/213P/674T/684V; 40A/132Y/157G/514F/520P/684V; 40A/41F/213P/684V/772I; 40A/41F/231E/503I/814E; 88T/213P/503I/584N/814E; 40A/41F/132Y/562S/584N; 41F/88T/213P/231E/503I/650A/748Y; 40A/503I; 40A/132Y/213P/231E/520P/562S/650A/814E; 40A/41F/132Y/231E/262L/503I/562S/584N/748Y/814E; 88T/132Y/157G/262L/263A/520P/562S; 88T/132Y/157G/262L/503I/514F/562S/650A; 40A/584N/674T/748Y; 40A/41F/132Y/263A/503I; 584N/748Y; 40A/213P/674T; 40A/41F/88T/132Y/503I/562S/584N/748Y; 263A/520P/814E; or 40A/41F/88T/157G, wherein the amino acid positions are relative to the reference sequence of SEQ ID NO: 2.

15. The method of claim 9, wherein the complementary DNA is detected by amplifying the complementary DNA.

16. The method of claim 15, wherein the amplifying is by polymerase chain reaction (PCR) or isothermal amplification.

17. The method of claim 16, wherein the isothermal amplification is by loop-mediated isothermal amplification (LAMP).

18. The method of claim 10, wherein the conditions is for LAMP.

19. The engineered DNA polymerase of claim 1, wherein the polypeptide sequence comprises at least the substitution at amino acid position 40, wherein the substitution is 40A.

20. The engineered DNA polymerase of claim 1, wherein the polypeptide sequence comprises at least the substitution at amino acid position 85, wherein the substitution is 85E/R/S.

21. The engineered DNA polymerase of claim 1, wherein the polypeptide sequence comprises at least the substitution at amino acid position 102, wherein the substitution is 102V/M.

22. The engineered DNA polymerase of claim 1, wherein the polypeptide sequence comprises at least the substitution at amino acid position 132, wherein the substitution is 132Y.

23. The engineered DNA polymerase of claim 1, wherein the polypeptide sequence comprises at least the substitution at amino acid position 157, wherein the substitution is 157G.

24. The engineered DNA polymerase of claim 1, wherein the polypeptide sequence comprises at least the substitution at amino acid position 177, wherein the substitution is 177T.

25. The engineered DNA polymerase of claim 1, wherein the polypeptide sequence comprises at least the substitution at amino acid position 262, wherein the substitution is 262L.

26. The engineered DNA polymerase of claim 1, wherein the polypeptide sequence comprises at least the substitution at amino acid position 263, wherein the substitution is 263A.

27. The engineered DNA polymerase of claim 1, wherein the polypeptide sequence comprises at least the substitution at amino acid position 503, wherein the substitution is 503I/V.

28. The engineered DNA polymerase of claim 1, wherein the polypeptide sequence comprises at least the substitution 521G/W/Y.

29. The engineered DNA polymerase of claim 1, wherein the polypeptide sequence comprises at least the substitution at amino acid position 750, wherein the substitution is 750S/P.

30. The engineered DNA polymerase of claim 1, comprising a polypeptide sequence having at least 91%, 92%, 93%, 94%, or more sequence identity to the reference sequence corresponding to residues 12 to 850 of SEQ ID NO: 606, or to the reference sequence corresponding to SEQ ID NO: 606.

31. The engineered DNA polymerase of claim 1, comprising a polypeptide sequence having at least 95% or more sequence identity to the reference sequence corresponding to residues 12 to 850 of SEQ ID NO: 606, or to the reference sequence corresponding to SEQ ID NO: 606.

32. The engineered DNA polymerase of claim 1, comprising a polypeptide sequence having at least 96% or more sequence identity to the reference sequence corresponding to residues 12 to 850 of SEQ ID NO: 606, or to the reference sequence corresponding to SEQ ID NO: 606.

33. The engineered DNA polymerase of claim 1, comprising a polypeptide sequence having at least 97% or more sequence identity to the reference sequence corresponding to residues 12 to 850 of SEQ ID NO: 606, or to the reference sequence corresponding to SEQ ID NO: 606.

34. The engineered DNA polymerase of claim 1, comprising a polypeptide sequence having at least 98% or more sequence identity to the reference sequence corresponding to residues 12 to 850 of SEQ ID NO: 606, or to the reference sequence corresponding to SEQ ID NO: 606.

35. The engineered DNA polymerase of claim 1, comprising a polypeptide sequence having at least 99% or more sequence identity to the reference sequence corresponding to residues 12 to 850 of SEQ ID NO: 606, or to the reference sequence corresponding to SEQ ID NO: 606.

* * * * *